United States Patent
Izhar et al.

(10) Patent No.: US 11,827,879 B2
(45) Date of Patent: Nov. 28, 2023

(54) DIFFERENTIAL KNOCKOUT OF AN ALLELE OF A HETEROZYGOUS BESTROPHIN 1 GENE

(71) Applicant: EmendoBio Inc., Wilmington, DE (US)

(72) Inventors: Lior Izhar, Tel Aviv (IL); David Baram, Nir Zvi (IL); Joseph Georgeson, Rehevot (IL); Michal Golan-Mashiach, Ness-Ziona (IL); Asael Herman, Ness-Ziona (IL); Rafi Emmanuel, Ramla (IL)

(73) Assignee: EmendoBio, Inc., Wilmington, DE (US)

( * ) Notice: Subject to any disclaimer, the term of this patent is extended or adjusted under 35 U.S.C. 154(b) by 1105 days.

(21) Appl. No.: 16/203,094

(22) Filed: Nov. 28, 2018

(65) Prior Publication Data

US 2023/0174974 A1    Jun. 8, 2023

Related U.S. Application Data

(60) Provisional application No. 62/680,482, filed on Jun. 4, 2018, provisional application No. 62/591,365, filed on Nov. 28, 2017.

(51) Int. Cl.
| | | |
|---|---|---|
| *C12N 15/11* | (2006.01) | |
| *C12N 9/22* | (2006.01) | |
| *C12N 15/90* | (2006.01) | |

(52) U.S. Cl.
CPC ............... *C12N 15/11* (2013.01); *C12N 9/22* (2013.01); *C12N 15/90* (2013.01); *C12N 2310/20* (2017.05)

(58) Field of Classification Search
CPC .......................... C12N 2310/20; C12N 15/90
See application file for complete search history.

(56) References Cited

FOREIGN PATENT DOCUMENTS

| WO | PCT/US18/62871 | 11/2018 |
|---|---|---|
| WO | PCT/US19/23715 | 3/2019 |

OTHER PUBLICATIONS

DbSNP entry for rs1800009, printed from https://www.ncbi.nlm.nih.gov/snp/rs1800009, on Feb. 26, 2022 as pp. 1/14-14/14. (Year: 2022).*
Nowak et al. Guide RNA engineering for versatile Cas9 functionality. Nucleic Acids Research, vol. 44, No. 20, pp. 9555-9564, Oct. 12, 2016. (Year: 2016).*
Zetsche et al. Cpf1 is a single RNA-guided endonuclease of a class 2 CRISPR-Cas system. Cell, vol. 163, pp. 759-771, S1-S7, and pp. 1/9-9/9 of Supplemental Information, Oct. 22, 2015. (Year: 2015).*
Schmakov et al. Discovery and functional characterization of diverse Class 2 CRISPR-Cas systems. Molecular Cell, vol. 60, pp. 385-397, Nov. 5, 2015. (Year: 2015).*
Hung et al. Genome engineering in ophthalmology: Application of CRISPR/Cas to the treatment of eye disease. Progress in Retinal and Eye Research, vol. 53, pp. 1-20, May 13, 2016. (Year: 2016).*
Yang et al. BEST1: The best target for gene and cell therapies. Molecular Therapy, vol. 23, No. 12, pp. 1805-1809, Oct. 27, 2015. (Year: 2015).*
Monteys et al. CRISPR/Cas9 editing of the mutant huntingtin allele in vitro and in vivo. Molecular Therapy, vol. 25, No. 1, pp. 12-23, Jan. 1, 2017. (Year: 2017).*
Hung et al. Genome engineering in ophthalmology: Application of CRISPR/Cas to treatment of eye disease. Progress in Retinal and Eye Research, vol. 53, pp. 1-20, May 13, 2016. (Year: 2016).*
U.S. Appl. No. 16/202,955, filed Nov. 28, 2018, Izhar.
U.S. Appl. No. 16/203,004, filed Nov. 28, 2018, Izhar.
U.S. Appl. No. 16/203,056, filed Nov. 28, 2018, Izhar.
U.S. Appl. No. 16/202,867, filed Nov. 28, 2018, Izhar.
U.S. Appl. No. 16/203,134, filed Nov. 28, 2018, Izhar.
U.S. Appl. No. 16/203,169, filed Nov. 28, 2018, Izhar.
U.S. Appl. No. 16/203,231, filed Nov. 28, 2018, Izhar.
Burstein et al. (2017), "New CRISPR-Cas systems from uncultivated microbes," Nature 542:237-41.
Sentmanat et al. (2018), "A Survey of Validation Strategies for CRISPR-Cas9 Editing," Scientific Reports 8:888, doi: 10.1038/s41598-018-19441-8.
Zuris et al. (2015), "Cationic lipid-mediated delivery of proteins enables efficient protein based genome editing in vitro and in vivo," Nat Biotechnol. 33(1):73-80.
Buch et al., "AAV-mediated gene therapy for retinal disorders: from mouse to man" Gene Therapy (2008) 15, 849-857.
Han Z et al. (2012), "Comparative Analysis of DNA Nanoparticles and AAVs for Ocular Gene Delivery" Plos ONE 7(12): e52189.
Ralph et al., "Gene therapy for neurodegenerative and ocular diseases using lentiviral vectors" Clinical Science (2006), 110, 37-46.
Wang et al. J. "Lipid Nanoparticles for Ocular Gene Therapy" Funct. Biomater. 2015, 6, 379-394.

* cited by examiner

*Primary Examiner* — Jennifer Dunston
(74) *Attorney, Agent, or Firm* — Seyfarth Shaw LLP; Jamaica Szeliga

(57) ABSTRACT

RNA molecules comprising a guide sequence portion having 17-20 nucleotides in the sequence of 17-20 contiguous nucleotides set forth in any one of SEQ ID NOs: 1-3010 and compositions, methods, and uses thereof.

11 Claims, No Drawings
Specification includes a Sequence Listing.

DIFFERENTIAL KNOCKOUT OF AN ALLELE OF A HETEROZYGOUS BESTROPHIN 1 GENE

This application claims the benefit of U.S. Provisional Application No. 62/680,482, filed Jun. 4, 2018 and U.S. Provisional Application No. 62/591,365, filed Nov. 28, 2017, the contents of each of which are hereby incorporated by reference.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide sequences which are present in the filed named "220803_90240-A_Substitute_Sequence_Listing_AWG.txt", which is 552 kilobytes in size, and which was created on May 23, 2022 in the IBM-PC machine format, having an operating system compatibility with MS-Windows, which is contained in the text file filed Aug. 3, 2022 as part of this application.

BACKGROUND OF INVENTION

There are several classes of DNA variation in the human genome, including insertions and deletions, differences in the copy number of repeated sequences, and single nucleotide polymorphisms (SNPs). A SNP is a DNA sequence variation occurring when a single nucleotide (adenine (A), thymine (T), cytosine (C), or guanine (G)) in the genome differs between human subjects or paired chromosomes in an individual. Over the years, the different types of DNA variations have been the focus of the research community either as markers in studies to pinpoint traits or disease causation or as potential causes of genetic disorders.

A genetic disorder is caused by one or more abnormalities in the genome. Genetic disorders may be regarded as either "dominant" or "recessive." Recessive genetic disorders are those which require two copies (i.e., two alleles) of the abnormal/defective gene to be present. In contrast, a dominant genetic disorder involves a gene or genes which exhibit(s) dominance over a normal (functional/healthy) gene or genes. As such, in dominant genetic disorders only a single copy (i.e., allele) of an abnormal gene is required to cause or contribute to the symptoms of a particular genetic disorder. Such mutations include, for example, gain-of-function mutations in which the altered gene product possesses a new molecular function or a new pattern of gene expression. Other examples include dominant negative mutations, which have a gene product that acts antagonistically to the wild-type allele.

Best Vitelliform Macular Dystrophy

Best vitelliform macular dystrophy is commonly a slowly progressive macular dystrophy with onset generally in childhood and sometimes in later teenage years. Affected individuals may initially have normal vision followed by decreased central visual acuity and metamorphopsia. Individuals retain normal peripheral vision and dark adaptation. Best vitelliform macular dystrophy is commonly inherited in an autosomal dominant manner, although, autosomal recessive inheritance has also been reported. Mutations in bestrophin 1 gene (BEST1) have been associated with autosomal dominant Best vitelliform macular dystrophy.

SUMMARY OF THE INVENTION

Disclosed is an approach for knocking out the expression of a dominant-mutated allele by disrupting the dominant-mutated allele or degrading the resulting mRNA.

The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutated allele"), and the other allele encoding for a functional protein ("functional allele"). In some embodiments, the method further comprises the step of knocking out expression of the mutated protein and allowing expression of the functional protein.

According to embodiments of the present invention, there is provided a first RNA molecule comprising a guide sequence portion having 17-20 nucleotides in the sequence of 17-contiguous nucleotides set forth in any one of SEQ ID NOs: 1-3010.

According to embodiments of the present invention, there is provided a first RNA molecule comprising a guide sequence portion having 17-20 contiguous nucleotides set forth in any one of SEQ ID NOs: 1-3010.

According to some embodiments of the present invention, there is provided a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for inactivating a mutant BEST1 allele in a cell, the method comprising delivering to the cell a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for treating Best Vitelliform Macular Dystrophy, the method comprising delivering to a subject having Best Vitelliform Macular Dystrophy, a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for inactivating a mutant BEST1 allele in a cell, comprising delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, there is provided a medicament comprising an RNA molecule comprising a guide sequence portion having 17-20 nucleotides in the sequence of 17-20 contiguous nucleotides set forth in any one of SEQ ID NOs: 1-3010 and a CRISPR nuclease for use in inactivating a mutant BEST1 allele in a cell, wherein the medicament is administered by delivering to the cell the composition comprising an RNA molecule comprising a guide sequence portion having 17-20 nucleotides in the sequence of 17-contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for treating ameliorating or preventing Best Vitelliform Macular Dystrophy, comprising delivering to a subject having or at risk of having Best Vitelliform Macular Dystrophy the composition of comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a medicament comprising the composition comprising an RNA molecule comprising a guide sequence portion having 17-20 nucleotides in the sequence of 17-20 contiguous nucleotides set forth in any one of SEQ ID NOs: 1-3010 and a CRISPR nuclease for use in treating ameliorating or preventing Best Vitelliform Macular Dystrophy, wherein the medicament is administered by delivering to a subject having or at risk of having Best Vitelliform Macular Dystrophy the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a kit for inactivating a mutant BEST1 allele in a cell, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating Best Vitelliform Macular Dystrophy in a subject, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to a subject having or at risk of having Best Vitelliform Macular Dystrophy.

DETAILED DESCRIPTION

Definitions

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

It should be understood that the terms "a" and "an" as used above and elsewhere herein refer to "one or more" of the enumerated components. It will be clear to one of ordinary skill in the art that the use of the singular includes the plural unless specifically stated otherwise. Therefore, the terms "a," "an" and "at least one" are used interchangeably in this application.

For purposes of better understanding the present teachings and in no way limiting the scope of the teachings, unless otherwise indicated, all numbers expressing quantities, percentages or proportions, and other numerical values used in the specification and claims, are to be understood as being modified in all instances by the term "about." Accordingly, unless indicated to the contrary, the numerical parameters set forth in the following specification and attached claims are approximations that may vary depending upon the desired properties sought to be obtained. At the very least, each numerical parameter should at least be construed in light of the number of reported significant digits and by applying ordinary rounding techniques.

Unless otherwise stated, adjectives such as "substantially" and "about" modifying a condition or relationship characteristic of a feature or features of an embodiment of the invention, are understood to mean that the condition or characteristic is defined to within tolerances that are acceptable for operation of the embodiment for an application for which it is intended. Unless otherwise indicated, the word "or" in the specification and claims is considered to be the inclusive "or" rather than the exclusive or, and indicates at least one of, or any combination of items it conjoins.

In the description and claims of the present application, each of the verbs, "comprise," "include" and "have" and conjugates thereof, are used to indicate that the object or objects of the verb are not necessarily a complete listing of components, elements or parts of the subject or subjects of the verb. Other terms as used herein are meant to be defined by their well-known meanings in the art.

The "guide sequence portion" of an RNA molecule refers to a nucleotide sequence that is capable of hybridizing to a specific target DNA sequence, e.g., the guide sequence portion has a nucleotide sequence which is fully complementary to said target DNA sequence. In some embodiments, the guide sequence portion is 17, 18, 19, 20, 21, 22, 23, or 24 nucleotides in length, or approximately 17-24, 18-22, 19-22, 18-20, or 17-20 nucleotides in length. The guide sequence portion may be part of an RNA molecule that can form a complex with a CRISPR nuclease with the guide sequence portion serving as the DNA targeting portion of the CRISPR complex. When the DNA molecule having the guide sequence portion is present contemporaneously with the CRISPR molecule the RNA molecule is capable of targeting the CRISPR nuclease to the specific target DNA sequence. Each possibility represents a separate embodiment. An RNA molecule can be custom designed to target any desired sequence.

In embodiments of the present invention, an RNA molecule comprises a guide sequence portion having 17-20 nucleotides in the sequence of 17-20 contiguous nucleotides set forth in any one of SEQ ID NOs: 1-3010, 1-714, or 715-3010.

As used herein, "contiguous nucleotides" set forth in a SEQ ID NO refers to nucleotides in a sequence of nucleotides in the order set forth in the SEQ ID NO without any intervening nucleotides.

In embodiments of the present invention, the guide sequence portion may be 20 nucleotides in length and consists of 20 nucleotides in the sequence of 20 contiguous nucleotides set forth in any one of SEQ ID NOs: 1-3010. In embodiments of the present invention, the guide sequence portion may be less than 20 nucleotides in length. For example, in embodiments of the present invention the guide sequence portion may be 17, 18, or 19 nucleotides in length. In such embodiments the guide sequence portion may consist of 17, 18, or 19 nucleotides, respectively, in the sequence of 17-20 contiguous nucleotides set forth in any one of SEQ ID NOs: 1-3010. For example, a guide sequence portion having 17 nucleotides in the sequence of 17 contiguous nucleotides set forth in SEQ ID NO: 1 may consist of any one of the following nucleotide sequences (nucleotides excluded from the contiguous sequence are marked in strike-through):

AUCCGUCAGGUUAAACUCCA (SEQ ID NO: 1)
17 nucleotide guide sequence 1: CGUCAGGUUAAA-CUCCA (SEQ ID NO: 3011)
17 nucleotide guide sequence 2: CCGUCAGGUUAAA-CUCC (SEQ ID NO: 3012)
17 nucleotide guide sequence 3: UCCGUCAG-GUUAAACUC (SEQ ID NO: 3013)
17 nucleotide guide sequence 4: AUCCGUCAG-GUUAAACU (SEQ ID NO: 3014)

In embodiments of the present invention, the guide sequence portion may be greater than 20 nucleotides in length. For example, in embodiments of the present invention the guide sequence portion may be 21, 22, 23, or 24 nucleotides in length. In such embodiments the guide sequence portion comprises 20 nucleotides in the sequence of 20 contiguous nucleotides set forth in any one of SEQ ID NOs: 1-3010 and additional nucleotides fully complimentary to a nucleotide or sequence of nucleotides adjacent to the 3' end of the target sequence, 5' end of the target sequence, or both.

In embodiments of the present invention a CRISPR nuclease and an RNA molecule comprising a guide sequence portion form a CRISPR complex that binds to a target DNA sequence to effect cleavage of the target DNA sequence. CRISPR nucleases, e.g. Cpf1, may form a CRISPR complex comprising a CRISPR nuclease and RNA molecule without a further tracrRNA molecule. Alternatively, CRISPR nucleases, e.g. Cas9, may form a CRISPR complex between the CRISPR nuclease, an RNA molecule, and a tracrRNA molecule.

In embodiments of the present invention, the RNA molecule may further comprise the sequence of a tracrRNA molecule. Such embodiments may be designed as a synthetic fusion of the guide portion of the RNA molecule and the trans-activating crRNA (tracrRNA). (See Jinek (2012) Science). Embodiments of the present invention may also form CRISPR complexes utilizing a separate tracrRNA molecule and a separate RNA molecule comprising a guide sequence portion. In such embodiments the tracrRNA molecule may hybridize with the RNA molecule via basepairing and may be advantageous in certain applications of the invention described herein.

The term "tracr mate sequence" refers to a sequence sufficiently complementary to a tracrRNA molecule so as to hybridize to the tracrRNA via basepairing and promote the formation of a CRISPR complex. (See e.g., U.S. Pat. No. 8,906,616). In embodiments of the present invention, the RNA molecule may further comprise a portion having a tracr mate sequence.

A "gene," for the purposes of the present disclosure, includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Eukaryotic" cells include, but are not limited to, fungal cells (such as yeast), plant cells, animal cells, mammalian cells and human cells.

The term "nuclease" as used herein refers to an enzyme capable of cleaving the phosphodiester bonds between the nucleotide subunits of nucleic acid. A nuclease may be isolated or derived from a natural source. The natural source may be any living organism. Alternatively, a nuclease may be a modified or a synthetic protein which retains the phosphodiester bond cleaving activity. Gene modification can be achieved using a nuclease, for example a CRISPR nuclease.

Embodiments

The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutated allele"), and the other allele encoding for a functional protein ("functional allele"). The method further comprises the step of knocking out expression of the mutated protein and allowing expression of the functional protein. In some embodiments, the method is for treating, ameliorating, or preventing a dominant negative genetic disorder.

According to embodiments of the present invention, there is provided a first RNA molecule comprising a guide sequence portion having 17-20 nucleotides in the sequence of 17-contiguous nucleotides set forth in any one of SEQ ID NOs: 1-3010.

According to embodiments of the present invention, there is provided a first RNA molecule comprising a guide sequence portion having 17-20 contiguous nucleotides set forth in any one of SEQ ID NOs: 1-3010.

According embodiments of the present invention, an RNA molecule may further comprise a portion having a sequence which binds to a CRISPR nuclease.

According to embodiments of the present invention, the sequence which binds to a CRISPR nuclease is a tracrRNA sequence.

According to embodiments of the present invention, an RNA molecule may further comprise a portion having a tracr mate sequence.

According to embodiments of the present invention, an RNA molecule may further comprise one or more linker portions.

According to embodiments of the present invention, an RNA molecule may be up to 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

According to some embodiments of the present invention, there is provided a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, the composition may comprise a second RNA molecule comprising a guide sequence portion.

According to embodiments of the present invention, the guide sequence portion of the second RNA molecule comprises 17-20 nucleotides in the sequence of 17-20 contiguous nucleotides set forth in any one of SEQ ID NOs: 1-3010.

According to embodiments of the present invention, the 17-20 nucleotides of the guide sequence portion of the second RNA molecule are in a different sequence from the sequence of the guide sequence portion of the first RNA molecule Embodiments of the present invention may comprise a tracrRNA molecule.

According to some embodiments of the present invention, there is provided a method for inactivating a mutant BEST1 allele in a cell, the method comprising delivering to the cell a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for treating Best Vitelliform Macular Dystrophy, the method comprising delivering to a subject having Best Vitelliform Macular Dystrophy a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, the composition comprises a second RNA molecule comprising a guide sequence portion having 17-20 nucleotides in the sequence of 17-20 contiguous nucleotides set forth in any one of SEQ ID NOs: 1-3010.

According to embodiments of the present invention, the 17-20 nucleotides of the guide sequence portion of the second RNA molecule are in a different sequence from the sequence of the guide sequence portion of the first RNA molecule According to embodiments of the present invention, the CRISPR nuclease and the RNA molecule or RNA molecules are delivered to the subject and/or cells substantially at the same time or at different times.

According to embodiments of the present invention, the tracrRNA is delivered to the subject and/or cells substantially at the same time or at different times as the CRISPR nuclease and RNA molecule or RNA molecules.

According to embodiments of the present invention, the first RNA molecule targets a SNP or disease-causing mutation in an exon or promoter of a mutated allele, and wherein the second RNA molecule targets a SNP in the same or a different exon of the mutated allele, a SNP in an intron, or a sequence in an intron present in both the mutated or functional allele.

According to embodiments of the present invention, the first RNA molecule or the first and the second RNA molecules target a SNP in the promoter region, the start codon, or the untranslated region (UTR) of a mutated allele.

According to embodiments of the present invention, the first RNA molecule or the first and the second RNA molecules targets at least a portion of the promoter and/or the start codon and/or a portion of the UTR of a mutated allele.

According to embodiments of the present invention, the first RNA molecule targets a portion of the promoter, a first SNP in the promoter, or a SNP upstream to the promoter of a mutated allele and the second RNA molecule is targets a second SNP, which is downstream of the first SNP, and is in the promoter, in the UTR, or in an intron or in an exon of a mutated allele.

According to embodiments of the present invention, the first RNA molecule targets a SNP in the promoter, upstream of the promoter, or the UTR of a mutated allele and the second RNA molecule is designed to target a sequence which is present in an intron of both the mutated allele and the functional allele.

According to embodiments of the present invention, the first RNA molecule targets a sequence upstream of the promotor which is present in both a mutated and functional allele and the second RNA molecule targets a SNP or disease-causing mutation in any location of the gene.

According to embodiments of the present invention, there is provided a method comprising removing an exon containing a disease-causing mutation from a mutated allele, wherein the first RNA molecule or the first and the second RNA molecules target regions flanking an entire exon or a portion of the exon.

According to embodiments of the present invention, there is provided a method comprising removing multiple exons, the entire open reading frame of a gene, or removing the entire gene.

According to embodiments of the present invention, the first RNA molecule targets a SNP or disease-causing mutation in an exon or promoter of a mutated allele, and wherein the second RNA molecule targets a SNP in the same or a different exon of the mutated allele, a SNP in an intron, or a sequence in an intron present in both the mutated or functional allele.

According to embodiments of the present invention, the first RNA molecule or the first and the second RNA molecules target an alternative splicing signal sequence between an exon and an intron of a mutant allele.

According to embodiments of the present invention, the second RNA molecule targets a sequence present in both a mutated allele and a functional allele.

According to embodiments of the present invention, the second RNA molecule targets an intron.

According to embodiments of the present invention, there is provided a method comprising subjecting the mutant allele to insertion or deletion by an error prone non-homologous end joining (NHEJ) mechanism, generating a frameshift in the mutated allele's sequence.

According to embodiments of the present invention, the frameshift results in inactivation or knockout of the mutated allele.

According to embodiments of the present invention, the frameshift creates an early stop codon in the mutated allele.

According to embodiments of the present invention, the frameshift results in nonsense-mediated mRNA decay of the transcript of the mutant allele.

According to embodiments of the present invention, the inactivating or treating results in a truncated protein encoded by the mutated allele and a functional protein encoded by the functional allele.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease inactivating a mutant BEST1 allele in a cell, comprising delivering to the cell the RNA molecule comprising a guide sequence portion having 17-20 nucleotides in the sequence of 17-20 contiguous nucleotides set forth in any one of SEQ ID NOs: 1-3010 and the CRISPR nuclease.

According to embodiments of the present invention, there is provided a medicament comprising an RNA molecule comprising a guide sequence portion having 17-20 nucleotides in the sequence of 17-20 contiguous nucleotides set forth in any one of SEQ ID NOs: 1-3010 and a CRISPR nuclease for use in inactivating a mutant BEST1 allele in a cell, wherein the medicament is administered by delivering to the cell the composition comprising an RNA molecule comprising a guide sequence portion having 17-20 nucleotides in the sequence of 17-contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for treating ameliorating or preventing Best Vitelliform Macular Dystrophy, comprising delivering to a subject having or at risk of having Best Vitelliform Macular Dystrophy the composition of comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a medicament comprising the composition comprising an RNA molecule comprising a guide sequence portion having 17-20 nucleotides in the sequence of 17-20 contiguous nucleotides set forth in any one of SEQ ID NOs: 1-3010 and a CRISPR nuclease for use in treating ameliorating or preventing Best Vitelliform Macular Dystrophy, wherein the medicament is administered by delivering to a subject having or at risk of having Best Vitelliform Macular Dystrophy: the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a kit for inactivating a mutant BEST1 allele in a cell, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating Best Vitelliform Macular Dystrophy in a subject, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to a subject having or at risk of having Best Vitelliform Macular Dystrophy.

In embodiments of the present invention, the RNA molecule comprises a guide sequence portion having 17-20 nucleotides in the sequence of 17-20 contiguous nucleotides set forth in any one of SEQ ID NOs: 1-714, SEQ ID NOs: 715-3010, or SEQ ID NOs 1-3010.

The compositions and methods of the present disclosure may be utilized for treating, preventing, ameliorating, or slowing progression of Best Vitelliform Macular Dystrophy.

In some embodiments, a mutated allele is deactivated by delivering to a cell an RNA molecule which targets a SNP in the promoter region, the start codon, or the untranslated region (UTR) of the mutated allele.

In some embodiments, a mutated allele is inactivated by removing at least a portion of the promoter and/or removing the start codon and/or a portion of the UTR. In some embodiments, the method of deactivating a mutated allele comprises removing at least a portion of the promoter. In such embodiments one RNA molecule may be designed for targeting a first SNP in the promoter or upstream to the promoter and another RNA molecule is designed to target a second SNP, which is downstream of the first SNP, and is in the promoter, in the UTR, or in an intron or in an exon. Alternatively, one RNA molecule may be designed for targeting a SNP in the promoter, or upstream of the promoter, or the UTR and another RNA molecule is designed to target a sequence which is present in an intron of both the mutated allele and the functional allele. Alternatively, one RNA molecule may be designed for targeting a sequence upstream of the promotor which is present in both the mutated and functional allele and the other guide is designed to target a SNP or disease-causing mutation in any location of the gene e.g., in an exon, intron, UTR, or downstream of the promoter.

In some embodiments, the method of deactivating a mutated allele comprises an exon skipping step comprising removing an exon containing a disease-causing mutation from the mutated allele. Removing an exon containing a disease-causing mutation in the mutated allele requires two RNA molecules which target regions flanking the entire exon or a portion of the exon. Removal of an exon containing the disease-causing mutation may be designed to eliminate the disease-causing action of the protein while allowing for expression of the remaining protein product which retains some or all of the wild-type activity. As an alternative to single exon skipping, multiple exons, the entire open reading frame or the entire gene can be excised using two RNA molecules flanking the region desired to be excised.

In some embodiments, the method of deactivating a mutated allele comprises delivering two RNA molecules to a cell, wherein one RNA molecule targets a SNP or disease-causing mutation in an exon or promoter of the mutated allele, and wherein the other RNA molecule targets a SNP in the same or a different exon of the mutated allele, a SNP in an intron, or a sequence in an intron present in both the mutated or functional allele.

In some embodiments, an RNA molecule is used to target a CRISPR nuclease to an alternative splicing signal sequence between an exon and an intron of a mutant allele, thereby destroying the alternative splicing signal sequence in the mutant allele.

Any one of, or combination of, the above-mentioned strategies for deactivating a mutant allele may be used in the context of the invention.

Additional strategies may be used to deactivate a mutated allele. For example, in embodiments of the present invention, an RNA molecule is used to direct a CRISPR nuclease to an exon or a splice site of a mutated allele in order to create a double-stranded break (DSB), leading to insertion or deletion of nucleotides by an error-prone non-homologous end-joining (NHEJ) mechanism and formation of a frameshift mutation in the mutated allele. The frameshift mutation may result in: (1) inactivation or knockout of the mutated allele by generation of an early stop codon in the mutated allele, resulting in generation of a truncated protein; or (2) nonsense mediated mRNA decay of the transcript of the mutant allele. In further embodiments, one RNA molecule is used to direct a CRISPR nuclease to a promotor of a mutated allele.

In some embodiments, the method of deactivating a mutated allele further comprises enhancing activity of the functional protein such as by providing a protein/peptide, a nucleic acid encoding a protein/peptide, or a small molecule such as a chemical compound, capable of activating/enhancing activity of the functional protein.

According to some embodiments, the present disclosure provides an RNA sequence ('RNA molecule') which binds to/associates with and/or directs the RNA guided DNA nuclease e.g., CRISPR nuclease to a sequence comprising at least one nucleotide which differs between a mutated allele and a functional allele (e.g., SNP) of a gene of interest (i.e., a sequence of the mutated allele which is not present in the functional allele).

In some embodiments, the method comprises the steps of: contacting a mutated allele of a gene of interest with an allele-specific RNA molecule and a CRISPR nuclease e.g., a Cas9 protein, wherein the allele-specific RNA molecule and the CRISPR nuclease e.g., Cas9 associate with a nucleotide sequence of the mutated allele of the gene of interest which differs by at least one nucleotide from a nucleotide sequence of a functional allele of the gene of interest, thereby modifying or knocking-out the mutated allele.

In some embodiments, the allele-specific RNA molecule and a CRISPR nuclease is introduced to a cell encoding the gene of interest. In some embodiments, the cell encoding the gene of interest is in a mammalian subject. In some embodiments, the cell encoding the gene of interest is in a plant.

In some embodiments, the cleaved mutated allele is further subjected to insertion or deletion (indel) by an error prone non-homologous end joining (NHEJ) mechanism, generating a frameshift in the mutated allele's sequence. In some embodiments, the generated frameshift results in inactivation or knockout of the mutated allele. In some embodiments, the generated frameshift creates an early stop codon in the mutated allele and results in generation of a truncated protein. In such embodiments, the method results in the generation of a truncated protein encoded by the mutated allele and a functional protein encoded by the functional allele. In some embodiments, a frameshift generated in a mutated allele using the methods of the invention results in nonsense-mediated mRNA decay of the transcript of the mutant allele.

In some embodiments, the mutated allele is an allele of the BEST1 gene. In some embodiments, the RNA molecule targets a SNP which co-exists with/is genetically linked to the mutated sequence associated with Best Vitelliform Macular Dystrophy genetic disorder. In some embodiments, the RNA molecule targets a SNP which is highly prevalent in the population and exists in the mutated allele having the mutated sequence associated with Best Vitelliform Macular Dystrophy genetic disorder and not in the functional allele of an individual subject to be treated. In some embodiments, a disease-causing mutation within a mutated BEST1 allele is targeted.

In some embodiments, the SNP is within an exon of the gene of interest. In such embodiments, a guide sequence portion of an RNA molecule may be designed to associate with a sequence of the exon of the gene of interest.

In some embodiments, SNP is within an intron or an exon of the gene of interest. In some embodiments, SNP is in close proximity to a splice site between the intron and the exon. In some embodiments, the close proximity to a splice site is 1, 2, 3, 4, 5, 6, 7, 8, 9, 10, 11, 12, 13, 14, 15, 16, 17, 18, 19, or 20 nucleotides upstream or downstream to the splice site. Each possibility represents a separate embodiment of the present invention. In such embodiments, a guide sequence portion of an RNA molecule may be designed to associate with a sequence of the gene of interest which comprises the splice site.

In some embodiments, the method is utilized for treating a subject having a disease phenotype resulting from the heterozygote BEST1 gene. In such embodiments, the method results in improvement, amelioration or prevention of the disease phenotype.

Embodiments referred to above refer to a CRISPR nuclease, RNA molecule(s), and tracrRNA being effective in a subject or cells at the same time. The CRISPR, RNA molecule(s), and tracrRNA can be delivered substantially at the same time or can be delivered at different times but have effect at the same time. For example, this includes delivering the CRISPR nuclease to the subject or cells before the RNA molecule and/or tracr RNA is substantially extant in the subject or cells.

In some embodiments, the cell is a retinal cell. In some embodiments, the cell is a Retinal pigment epithelium (RPE) cell.

Dominant Genetic Disorders

One of skill in the art will appreciate that all subjects with any type of heterozygote genetic disorder (e.g., dominant genetic disorder) may be subjected to the methods described herein. In one embodiment, the present invention may be used to target a gene involved in, associated with, or causative of dominant genetic disorders such as, for example treating Best Vitelliform Macular Dystrophy. In some embodiments, the dominant genetic disorder is treating Best Vitelliform Macular Dystrophy. In some embodiments, the target gene is the BEST1 gene (Entrez Gene, gene ID No: 7439).

CRISPR Nucleases and PAM Recognition

In some embodiments, the sequence specific nuclease is selected from CRISPR nucleases, or a functional variant thereof. In some embodiments, the sequence specific nuclease is an RNA guided DNA nuclease. In such embodiments, the RNA sequence which guides the RNA guided DNA nuclease (e.g., Cpf1) binds to and/or directs the RNA guided DNA nuclease to the sequence comprising at least one nucleotide which differs between a mutated allele and its counterpart functional allele (e.g., SNP). In some embodiments, the CRISPR complex does not further comprise a tracrRNA. In a non-limiting example, in which the RNA guided DNA nuclease is a CRISPR protein, the at least one nucleotide which differs between the dominant mutated allele and the functional allele may be within the PAM site and/or proximal to the PAM site within the region that the RNA molecule is designed to hybridize to. A skilled artisan will appreciate that RNA molecules can be engineered to bind to a target of choice in a genome by commonly known methods in the art.

In embodiments of the present invention, a type II CRISPR system utilizes a mature crRNA:tracrRNA complex directs a CRISPR nuclease, e.g. Cas9, to the target DNA via Watson-Crick base-pairing between the crRNA and the protospacer on the target DNA next to the protospacer adjacent motif (PAM), an additional requirement for target recognition. The CRISPR nuclease then mediates cleavage of target DNA to create a double-stranded break within the protospacer. A skilled artisan will appreciate that each of the engineered RNA molecule of the present invention is further designed such as to associate with a target genomic DNA sequence of interest next to a protospacer adjacent motif (PAM), e.g., a PAM matching the sequence relevant for the type of CRISPR nuclease utilized, such as for a non-limiting example, NGG or NAG, wherein "N" is any nucleobase, for *Streptococcus pyogenes* Cas9 WT (Sp-CAS9); NNGRRT for *Staphylococcus aureus* (SaCas9); NNNVRYM for *Jejuni* Cas9 WT; NGAN or NGNG for SpCas9-VQR variant; NGCG for SpCas9-VRER variant; NGAG for SpCas9-EQR variant; NNNNGATT for *Neisseria meningitidis* (NmCas9); or TTTV for Cpf1. RNA molecules of the present invention are each designed to form complexes in conjunction with one or more different CRISPR nucleases and designed to target polynucleotide sequences of interest utilizing one or more different PAM sequences respective to the CRISPR nuclease utilized.

In some embodiments, an RNA-guided DNA nuclease e.g., a CRISPR nuclease, may be used to cause a DNA break at a desired location in the genome of a cell. The most commonly used RNA-guided DNA nucleases are derived from CRISPR systems, however, other RNA-guided DNA nucleases are also contemplated for use in the genome editing compositions and methods described herein. For instance, see U.S. Patent Publication No. 2015-0211023, incorporated herein by reference.

CRISPR systems that may be used in the practice of the invention vary greatly. CRISPR systems can be a type I, a type II, or a type III system. Non-limiting examples of suitable CRISPR proteins include Cas3, Cas4, Cas5, Cas5e (or CasD), Cas6, Cas6e, Cas6f, Cas7, Cas8a1, Cas8a2, Cas8b, Cas8c, Cas9, Cas10, Casl Od, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csz1, Csx15, Csf1, Csf2, Csf3, Csf4, and Cul966.

In some embodiments, the RNA-guided DNA nuclease is a CRISPR nuclease derived from a type II CRISPR system (e.g., Cas9). The CRISPR nuclease may be derived from *Streptococcus pyogenes, Streptococcus thermophilus, Streptococcus* sp., *Staphylococcus aureus, Neisseria meningitidis, Treponema denticola, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina,* Burkholderiales *bacterium, Polaromonas naphthalenivorans, Polaromonas* sp., *Crocosphaera watsonii, Cyanothece* sp., *Microcystis aeruginosa, Synechococcus* sp., *Acetohalobium arabaticum, Ammonifex degensii, Caldicelulosiruptor becscii, Candidatus Desulforudis, Clostridium botulinum, Clostridium Finegoldia magna, Natranaerobius thermophilus, Pelotomaculumthermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina,* or any species which encodes a CRISPR nuclease with a known PAM sequence. CRISPR nucleases encoded by uncultured bacteria may also be used in the context of the invention. (See Burstein et al. Nature, 2017). Variants of CRIPSR proteins having known PAM sequences e.g., spCas9 D1135E variant, spCas9 VQR variant, spCas9 EQR variant, or spCas9 VRER variant may also be used in the context of the invention.

Thus, an RNA guided DNA nuclease of a CRISPR system, such as a Cas9 protein or modified Cas9 or homolog or ortholog of Cas9, or other RNA guided DNA nucleases belonging to other types of CRISPR systems, such as Cpf1 and its homologs and orthologs, may be used in the compositions of the present invention.

In certain embodiments, the CRIPSR nuclease may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some cases, the cell does not naturally produce Cas protein and is genetically engineered to produce a Cas protein.

In some embodiments, the CRISPR nuclease is Cpf1. Cpf1 is a single RNA-guided endonuclease which utilizes a T-rich protospacer-adjacent motif. Cpf1 cleaves DNA via a staggered DNA double-stranded break. Two Cpf1 enzymes from Acidaminococcus and Lachnospiraceae have been shown to carry out efficient genome-editing activity in human cells. (See Zetsche et al. (2015) Cell).

Thus, an RNA guided DNA nuclease of a Type II CRISPR System, such as a Cas9 protein or modified Cas9 or homologs, orthologues, or variants of Cas9, or other RNA guided DNA nucleases belonging to other types of CRISPR systems, such as Cpf1 and its homologs, orthologues, or variants, may be used in the present invention.

In some embodiments, the guide molecule comprises one or more chemical modifications which imparts a new or improved property (e.g., improved stability from degradation, improved hybridization energetics, or improved binding properties with an RNA guided DNA nuclease). Suitable chemical modifications include, but are not limited to: modified bases, modified sugar moieties, or modified internucleoside linkages. Non-limiting examples of suitable chemical modifications include: 4-acetylcytidine, 5-(carboxyhydroxymethyl)uridine, 2'-O-methylcytidine, 5-carboxymethylaminomethyl-2-thiouridine, 5-carboxymethylaminomethyluridine, dihydrouridine, 2'-O-methylpseudouridine, "beta. D-galactosylqueuosine", 2'-O-methylguanosine, inosine, N6-isopentenyladenosine, 1-methyladenosine, 1-methylpseudouridine, 1-methylguanosine, 1-methylinosine, "2,2-dimethylguanosine", 2-methyladenosine, 2-methylguanosine, 3-methylcytidine, 5-methylcytidine, N6-methyladenosine, 7-methylguanosine, 5-methylaminomethyluridine, 5-methoxyaminomethyl-2-thiouridine, "beta, D-mannosylqueuosine", 5-methoxycarbonylmethyl-2-thiouridine, 5-methoxycarbonylmethyluridine, 5-methoxyuridine, 2-methylthio-N6-isopentenyladenosine, N-((9-beta-D-ribofuranosyl-2-methylthiopurine-6-yl)carbamoyl)threonine, N-((9-beta-D-ribofuranosylpurine-6-yl)N-methylcarbamoyl)threonine, uridine-5-oxyacetic acid-methylester, uridine-5-oxyacetic acid, wybutoxosine, queuosine, 2-thiocytidine, 5-methyl-2-thiouridine, 2-thiouridine, 4-thiouridine, 5-methyluridine. N-((9-beta-D-ribofuranosylpurine-6-yl)-carbamoyl)threonine, 2'-O-methyl-5-methyluridine, 2'-O-methyluridine, wybutosine, "3-(3-amino-3-carboxy-propyl)uridine, (acp3) u", 2'-O-methyl (M), 3'-phosphorothioate (MS), 3'-thio-PACE (MSP), pseudouridine, or 1-methyl pseudo-uridine. Each possibility represents a separate embodiment of the present invention.

Guide Sequences which Specifically Target a Mutant Allele

A given gene may contain thousands of SNPs. Utilizing a 24 base pair target window for targeting each SNP in a gene would require hundreds of thousands of guide sequences. Any given guide sequence when utilized to target a SNP may result in degradation of the guide sequence, limited activity, no activity, or off-target effects. Accordingly, suitable guide sequences are necessary for targeting a given gene. By the present invention, a novel set of guide sequences have been identified for knocking out expression of a mutated BEST1 protein, inactivating a mutant BEST1 gene allele, and treating Best Vitelliform Macular Dystrophy.

The present disclosure provides guide sequences capable of specifically targeting a mutated allele for inactivation while leaving the functional allele unmodified. The guide sequences of the present invention are designed to, and are most likely to, specifically differentiate between a mutated allele and a functional allele. Of all possible guide sequences which target a mutated allele desired to be inactivated, the specific guide sequences disclosed herein are specifically effective to function with the disclosed embodiments.

Briefly, the guide sequences may have properties as follows: (1) target SNP/insertion/deletion/indel with a high prevalence in the general population, in a specific ethnic population or in a patient population is above 1% and the SNP/insertion/deletion/indel heterozygosity rate in the same population is above 1%; (2) target a location of a SNP/insertion/deletion/indel proximal to a portion of the gene e.g., within 5 k bases of any portion of the gene, for example, a promoter, a UTR, an exon or an intron; and (3) target a mutant allele using an RNA molecule which targets a founder or common pathogenic mutations for the disease/gene. In some embodiments, the prevalence of the SNP/insertion/deletion/indel in the general population, in a specific ethnic population or in a patient population is above 1%, 2%, 3%, 4%, 5%, 6%, 7%, 8%, 9%, 10%, 11%, 12%, 13%, 14%, or 15% and the SNP/insertion/deletion/indel heterozygosity rate in the same population is above 1%, 2%, 3%, 4%, 5%, 6%, 7%, 8%, 9%, 10%, 11%, 12%, 13%, 14%, or 15%. Each possibility represents a separate embodiment and may be combined at will.

For each gene, according to SNP/insertion/deletion/indel any one of the following strategies may be used to deactivate the mutated allele: (1) Knockout strategy using one RNA molecule—one RNA molecule is utilized to direct a CRISPR nuclease to a mutated allele and create a double-strand break (DSB) leading to formation of a frameshift mutation in an exon or in a splice site region of the mutated allele; (2) Knockout strategy using two RNA molecules—two RNA molecules are utilized. A first RNA molecule targets a region in the promoter or an upstream region of a mutated allele and another RNA molecule targets downstream of the first RNA molecule in a promoter, exon, or intron of the mutated allele; (3) Exon(s) skipping strategy—one RNA molecule may be used to target a CRISPR nuclease to a splice site region, either at the 5' end of an intron (donor sequence) or the 3' end of an intron (acceptor sequence), in order to destroy the splice site. Alternatively, two RNA molecules may be utilized such that a first RNA molecule targets an upstream region of an exon and a second RNA molecule targets a region downstream of the first RNA molecule, thereby excising the exon(s). Based on the locations of identified SNPs/insertions/deletions/indels for each mutant allele, any one of, or a combination of, the above-mentioned methods to deactivate the mutant allele may be utilized.

When only one RNA molecule is used is that the location of the SNP is in an exon or in close proximity (e.g., within 20 basepairs) to a splice site between the intron and the exon. When two RNA molecules are used, guide sequences may target two SNPs such that the first SNP is upstream of exon 1 e.g., within the 5' untranslated region, or within the promoter or within the first 2 kilobases 5' of the transcription start site, and the second SNP is downstream of the first SNP e.g., within the first 2 kilobases 5' of the transcription start site, or within intron 1, 2 or 3, or within exon 1, exon 2, or exon 3.

Guide sequences of the present invention may target a SNP in the upstream portion of the targeted gene, preferably upstream of the last exon of the targeted gene. Guide sequences may target a SNP upstream to exon 1, for example within the 5' untranslated region, or within the promoter or within the first 4-5 kilobases 5' of the transcription start site.

Guide sequences of the present invention may also target a SNP within close proximity (e.g., within 50 basepairs, more preferably with 20 basepairs) to a known protospacer adjacent motif (PAM) site.

Guide sequences of the present invention also may target: (1) a heterozygous SNP for the targeted gene; (2) a heterozygous SNPs upstream and downstream of the gene; (3) a SNPs with a prevalence of the SNP/insertion/deletion/indel in the general population, in a specific ethnic population, or in a patient population above 1%; (4) have a guanine-cytosine content of greater than 30% and less than 85%; (5) have no repeat of 4 or more thymine/uracil or 8 or more guanine, cytosine, or adenine; (6) having no off-target identified by off-target analysis; and (7) preferably target Exons over Introns or be upstream of a SNP rather than downstream of a SNP.

In embodiments of the present invention, the SNP may be upstream or downstream of the gene. In embodiments of the present invention, the SNP is within 4,000 base pairs upstream or downstream of the gene.

The at least one nucleotide which differs between the mutated allele and the functional allele, may be upstream, downstream or within the sequence of the disease-causing mutation of the gene of interest. The at least one nucleotide which differs between the mutated allele and the functional allele, may be within an exon or within an intron of the gene of interest. In some embodiments, the at least one nucleotide which differs between the mutated allele and the functional allele is within an exon of the gene of interest. In some embodiments, the at least one nucleotide which differs between the mutated allele and the functional allele is within an intron or an exon of the gene of interest, in close proximity to a splice site between the intron and the exon e.g., 1, 2, 3, 4, 5, 6, 7, 8, 9, 10, 11, 12, 13, 14, 15, 16, 17, 18, 19, or 20 nucleotides upstream or downstream to the splice site.

In some embodiments, the at least one nucleotide is a single nucleotide polymorphisms (SNPs). In some embodiments, each of the nucleotide variants of the SNP may be expressed in the mutated allele. In some embodiments, the SNP may be a founder or common pathogenic mutation.

Guide sequences may target a SNP which has both (1) a high prevalence in the general population e.g., above 1% in the population; and (2) a high heterozygosity rate in the population, e.g., above 1%. Guide sequences may target a SNP that is globally distributed. A SNP may be a founder or common pathogenic mutation. In some embodiments, the prevalence in the general population is above 1%, 2%, 3%, 4%, 5%, 6%, 7%, 8%, 9%, 10%, 11%, 12%, 13%, 14%, or 15%. Each possibility represents a separate embodiment. In some embodiments, the heterozygosity rate in the population is above 1%, 2%, 3%, 4%, 5%, 6%, 7%, 8%, 9%, 10%, 11%, 12%, 13%, 14%, or 15%. Each possibility represents a separate embodiment.

In some embodiments, the at least one nucleotide which differs between the mutated allele and the functional allele is linked to/co-exists with the disease-causing mutation in high prevalence in a population. In such embodiments, "high prevalence" refers to at least 92%, 93%, 94%, 95%, 96%, 97%, 98%, 99%, or 100%. Each possibility represents a separate embodiment of the present invention. In one embodiment, the at least one nucleotide which differs between the mutated allele and the functional allele, is a disease-associated mutation. In some embodiments, the SNP is highly prevalent in the population. In such embodiments, "highly prevalent" refers to at least 10%, 11%, 12%, 13%, 14%, 15%, 20%, 30%, 40%, 50%, 60%, or 70% of a population. Each possibility represents a separate embodiment of the present invention.

Guide sequences of the present invention may satisfy any one of the above criteria and are most likely to differentiate between a mutated allele from its corresponding functional allele.

In some embodiments the RNA molecule targets a SNP/WT sequence linked to SNPs as shown in Table 1 below. The SNP details are indicated in the 1$^{st}$ column and include: SNP ID No. (based on NCBI's 2018 database of Single Nucleotide Polymorphisms (dbSNP)). For variants with no available rs number variants characteristic are indicated based on gnomAD 2018 browser database. The 2$^{nd}$ column indicates an assigned identifier for each SNP. The 3$^{rd}$ column indicates the location of each SNP on the BEST1 gene.

TABLE 1

BEST1 gene SNPs

| RSID | SNP No. | SNP location in the gene |
|---|---|---|
| rs1800009 | s1 | Exon_10 of 11 |
| rs2524294 | s2 | Intron_2 of 10 |
| rs909268 | s3 | Intron_4 of 10 |
| rs2668898 | s4 | Intron_6 of 10 |
| rs972355 | s5 | upstream −18 bp |
| rs972353 | s6 | Exon_1 of 11 |
| rs2736597 | s7 | Intron_1 of 10 |
| rs1800007 | s8 | Exon_2 of 11 |
| rs760306 | s9 | Intron_4 of 10 |
| rs974121 | s10 | upstream −1048 bp |
| rs168991 | s11 | Intron_2 of 10 |
| rs195161 | s12 | Intron_5 of 10 |
| rs149698 | s13 | Exon_10 of 11 |
| rs1534842 | s14 | upstream −3765 bp |
| rs3758976 | s15 | upstream −250 bp |
| rs1800008 | s16 | Exon_10 of 11 |
| rs195158 | s17 | Intron_7 of 10 |
| rs195157 | s18 | Intron_9 of 10 |
| rs195156 | s19 | Intron_9 of 10 |
| rs2009875 | s20 | upstream −3323 bp |
| rs2955684 | s21 | Intron_6 of 10 |
| rs2955683 | s22 | Intron_6 of 10 |
| rs17185413 | s23 | Intron_10 of 10 |
| rs972354 | s24 | Exon_1 of 11 |
| rs195163 | s25 | Intron_4 of 10 |
| rs2668897 | s26 | Intron_10 of 10 |
| rs1109748 | s27 | Exon_3 of 11 |
| rs195160 | s28 | Intron_7 of 10 |
| rs183176 | s29 | Intron_2 of 10 |
| rs195167 | s30 | Intron_2 of 10 |
| rs195165 | s31 | Intron_3 of 10 |
| rs195164 | s32 | Intron_4 of 10 |
| rs2736594 | s33 | Intron_2 of 10 |
| rs195162 | s34 | Intron_5 of 10 |
| rs113492158 | s35 | Intron_6 of 10 |
| rs195166 | s36 | Intron_2 of 10 |
| rs741886 | s37 | Intron_5 of 10 |
| rs2736596 | s38 | Intron_1 of 10 |
| rs1801621 | s39 | Exon_11 of 11 |
| rs17156609 | s40 | downstream +42 bp |
| rs1534843 | s41 | upstream −3860 bp |
| rs73491300 | s42 | upstream −224 bp |
| rs74754540 | s43 | upstream −998 bp |
| rs112769638 | s44 | Intron_1 of 10 |
| rs71471844 | s45 | Intron_7 of 10 |
| rs1801393 | s46 | Exon_3 of 11 |
| rs185387478 | s47 | Intron_6 of 10 |
| rs180929734 | s48 | Intron_6 of 10 |
| rs111352087 | s49 | Intron_2 of 10 |
| rs57890952 | s50 | Intron_2 of 10 |
| rs145834822 | s51 | Intron_9 of 10 |
| rs1801390 | s52 | Exon_9 of 11 |
| rs17156602 | s53 | Intron_9 of 10 |
| rs11825719 | s54 | Intron_1 of 10 |
| rs75281081 | s55 | Exon_11 of 11 |
| rs57815521 | s56 | Intron_9 of 10 |
| rs73493223 | s57 | Intron_9 of 10 |
| rs111677305 | s58 | Intron_9 of 10 |
| rs74746022 | s59 | Intron_2 of 10 |
| rs75769763 | s60 | Intron_5 of 10 |
| rs114450910 | s61 | Intron_4 of 10 |
| rs74369809 | s62 | Intron_9 of 10 |
| rs78054615 | s63 | Intron_2 of 10 |
| rs144630276 | s64 | Intron_2 of 10 |
| rs141507235 | s65 | Intron_6 of 10 |
| rs114944671 | s66 | Intron_3 of 10 |
| rs1801327 | s67 | Exon_11 of 11 |
| rs78012644 | s68 | Intron_7 of 10 |
| rs112665957 | s69 | Intron_2 of 10 |
| rs139745332 | s70 | Intron_2 of 10 |
| rs77543508 | s71 | Intron_2 of 10 |
| rs78545127 | s72 | upstream −2638 bp |
| rs116516743 | s73 | upstream −2116 bp |
| rs1805140 | s74 | Exon_6 of 11 |
| rs73493205 | s75 | Intron_1 of 10 |
| rs77651946 | s76 | Intron_1 of 10 |
| rs195159 | s77 | Intron_7 of 10 |
| rs195155 | s78 | Intron_10 of 10 |
| rs2727272 | s79 | Intron_2 of 10 |
| rs2668899 | s80 | Intron_2 of 10 |
| rs2736595 | s81 | Intron_2 of 10 |

TABLE 1-continued

BEST1 gene SNPs

| RSID | SNP No. | SNP location in the gene |
|---|---|---|
| rs56215258 | s82 | Intron_10 of 10 |
| rs174481 | s83 | upstream −960 bp |
| rs168990 | s84 | Intron_4 of 10 |
| rs111509315 | s85 | Intron_9 of 10 |
| rs1735379 | s86 | Intron_7 of 10 |
| rs112720784 | s87 | Intron_2 of 10 |

Delivery to Cells

The RNA molecule compositions described herein may be delivered to a target cell by any suitable means. RNA molecule compositions of the present invention may be targeted to any cell which contains and/or expresses a dominant negative allele, including any mammalian or plant cell. For example, in one embodiment a guide sequence specifically targets a mutated BEST1 allele and the target cell is a retinal cell such as pigment epithelium (RPE), photoreceptors (e.g., rod and cone), glial cells (e.g., Müller), and ganglion cells. In some embodiments, the target cell is RPE. Further, the nucleic acid compositions described herein may be delivered as DNA molecules, RNA molecules, Ribonucleoproteins (RNP), nucleic acid vectors, or any combination thereof.

In some embodiments, the RNA molecule comprises a chemical modification. Non-limiting examples of suitable chemical modifications include 2'-0-methyl (M), 2'-0-methyl, 3'phosphorothioate (MS) or 2'-0-methyl, 3'thioPACE (MSP), pseudouridine, and 1-methyl pseudo-uridine. Each possibility represents a separate embodiment of the present invention.

Any suitable viral vector system may be used to deliver nucleic acid compositions e.g., the RNA molecule compositions of the subject invention. Conventional viral and non-viral based gene transfer methods can be used to introduce nucleic acids and target tissues. In certain embodiments, nucleic acids are administered for in vivo or ex vivo gene therapy uses. Non-viral vector delivery systems include naked nucleic acid, and nucleic acid complexed with a delivery vehicle such as a liposome or poloxamer. For a review of gene therapy procedures, see Anderson (1992) Science 256:808-813; Nabel & Felgner (1993) TIBTECH 11:211-217; Mitani & Caskey (1993) TIBTECH 11:162-166; Dillon (1993) TIBTECH 11:167-175; Miller (1992) Nature 357:455-460; Van Brunt (1988) Biotechnology 6(10):1149-1154; Vigne (1995) Restorative Neurology and Neuroscience 8:35-36; Kremer & Perricaudet (1995) British Medical Bulletin 51(1):31-44; Haddada et al. (1995) in Current Topics in Microbiology and Immunology Doerfler and Bohm (eds.); and Yu et al. (1994) Gene Therapy 1:13-26.

Methods of non-viral delivery of nucleic acids and/or proteins include electroporation, lipofection, microinjection, biolistics, particle gun acceleration, virosomes, liposomes, immunoliposomes, lipid nanoparticles (LNPs), polycation or lipid:nucleic acid conjugates, artificial virions, and agent-enhanced uptake of nucleic acids or can be delivered to plant cells by bacteria or viruses (e.g., *Agrobacterium, Rhizobium* sp. NGR234, Sinorhizoboiummeliloti, *Mesorhizobium loti*, tobacco mosaic virus, potato virus X, cauliflower mosaic virus and cassava vein mosaic virus). (See, e.g., Chung et al. (2006) Trends Plant Sci. 11(1):1-4). Sonoporation using, e.g., the Sonitron 2000 system (Rich-Mar), can also be used for delivery of nucleic acids. Cationic-lipid mediated delivery of proteins and/or nucleic acids is also contemplated as an in vivo or in vitro delivery method. (See Zuris et al. (2015) Nat. Biotechnol. 33(1):73-80; see also Coelho et al. (2013) N. Engl. J. Med. 369, 819-829; Judge et al. (2006) Mol. Ther. 13, 494-505; and Basha et al. (2011) Mol. Ther. 19, 2186-2200).

Additional exemplary nucleic acid delivery systems include those provided by Amaxa® Biosystems (Cologne, Germany), Maxcyte, Inc. (Rockville, Md.), BTX Molecular Delivery Systems (Holliston, Mass.) and Copernicus Therapeutics Inc., (see, e.g., U.S. Pat. No. 6,008,336). Lipofection is described in e.g., U.S. Pat. Nos. 5,049,386, 4,946,787; and 4,897,355, and lipofection reagents are sold commercially (e.g., Transfectam™, Lipofectin™ and Lipofectamine™ RNAiMAX). Cationic and neutral lipids that are suitable for efficient receptor-recognition lipofection of polynucleotides include those of Feigner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (See, e.g., Crystal (1995) Science 270:404-410; Blaese et al. (1995) Cancer Gene Ther. 2:291-297; Behr et al. (1994) Bioconjugate Chem. 5:382-389; Remy et al. (1994) Bioconjugate Chem. 5:647-654; Gao et al. (1995) Gene Therapy 2:710-722; Ahmad et al. (1992) Cancer Res. 52:4817-4820; U.S. Pat. Nos. 4,186,183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (See MacDiarmid et al (2009) Nature Biotechnology 27(7):643).

The use of RNA or DNA viral based systems for viral mediated delivery of nucleic acids take advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of nucleic acids include, but are not limited to, retroviral, lentivirus, adenoviral, adeno-associated, vaccinia and herpes simplex virus vectors for gene transfer.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system depends on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human immunodeficiency virus (HIV), and combinations thereof (See, e.g., Buchschacher et al. (1992) J. Virol. 66:2731-2739; Johann et al. (1992) J. Virol. 66:1635-1640; Sommerfelt et al. (1990) Virol. 176:58-59; Wilson et al. (1989) J. Virol. 63:2374-2378; Miller et al. (1991) J. Virol. 65:2220-2224; PCT/US94/05700).

At least six viral vector approaches are currently available for gene transfer in clinical trials, which utilize approaches that involve complementation of defective vectors by genes inserted into helper cell lines to generate the transducing agent.

pLASN and MFG-S are examples of retroviral vectors that have been used in clinical trials (Dunbar et al. (1995) Blood 85:3048-305; Kohn et al. (1995) Nat. Med. 1:1017-102; Malech et al. (1997) PNAS 94:22 12133-12138). PA317/pLASN was the first therapeutic vector used in a gene therapy trial. (Blaese et al. (1995). Transduction efficiencies of 50% or greater have been observed for MFG-S packaged vectors. (Ellem et al. (1997) Immunol Immunother. 44(1):10-20; Dranoff et al. (1997) Hum. Gene Ther. 1:111-2).

Packaging cells are used to form virus particles that are capable of infecting a host cell. Such cells include 293 cells, which package adenovirus, AAV, and Psi-2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additionally, AAV can be produced at clinical scale using baculovirus systems (see U.S. Pat. No. 7,479,554).

In many gene therapy applications, it is desirable that the gene therapy vector be delivered with a high degree of specificity to a particular tissue type. Accordingly, a viral vector can be modified to have specificity for a given cell type by expressing a ligand as a fusion protein with a viral coat protein on the outer surface of the virus. The ligand is chosen to have affinity for a receptor known to be present on the cell type of interest. For example, Han et al. (1995) Proc. Natl. Acad. Sci. USA 92:9747-9751, reported that Moloney murine leukemia virus can be modified to express human heregulin fused to gp70, and the recombinant virus infects certain human breast cancer cells expressing human epidermal growth factor receptor. This principle can be extended to other virus-target cell pairs, in which the target cell expresses a receptor and the virus expresses a fusion protein comprising a ligand for the cell-surface receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences which favor uptake by specific target cells.

Gene therapy vectors can be delivered in vivo by administration to an individual patient, typically by systemic administration (e.g., intravitreal, intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid composition, and re-infused back into the subject organism (e.g., patient). Various cell types suitable for ex vivo transfection are well known to those of skill in the art (See, e.g., Freshney et al. (1994) Culture of Animal Cells, A Manual of Basic Technique, 3rd ed, and the references cited therein for a discussion of how to isolate and culture cells from patients).

Suitable cells include, but are not limited to, eukaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NS0, SP2/0-Ag14, HeLa, HEK293 (e.g., HEK293-F, HEK293-H, HEK293-T), perC6 cells, any plant cell (differentiated or undifferentiated), as well as insect cells such as Spodopterafugiperda (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with a guided nuclease system (e.g. CRISPR/Cas). Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells (CD34+), neuronal stem cells and mesenchymal stem cells.

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-gamma, and TNF-alpha are known (as a non-limiting example see, Inaba et al., J. Exp. Med. 176:1693-1702 (1992)).

Stem cells are isolated for transduction and differentiation using known methods. For example, stem cells are isolated from bone marrow cells by panning the bone marrow cells with antibodies which bind unwanted cells, such as CD4+ and CD8+(T cells), CD45+(panB cells), GR-1 (granulocytes), and Tad (differentiated antigen presenting cells) (as a non-limiting example see Inaba et al. (1992) J. Exp. Med. 176:1693-1702). Stem cells that have been modified may also be used in some embodiments.

Any one of the RNA molecule compositions described herein is suitable for genome editing in post-mitotic cells or any cell which is not actively dividing, e.g., arrested cells. Examples of post-mitotic cells which may be edited using a composition of the present invention include, but are not limited to, a photoreceptor cell, a rod photoreceptor cell, a cone photoreceptor cell, a retinal pigment epithelium (RPE), a glial cell, Müller cell, and a ganglion.

Vectors (e.g., retroviruses, liposomes, etc.) containing therapeutic nucleic acid compositions can also be administered directly to an organism for transduction of cells in vivo. Administration is by any of the routes normally used for introducing a molecule into ultimate contact with blood or tissue cells including, but not limited to, injection, infusion, topical application (e.g., eye drops and cream) and electroporation. Suitable methods of administering such nucleic acids are available and well known to those of skill in the art, and, although more than one route can be used to administer a particular composition, a particular route can often provide a more immediate and more effective reaction than another route. According to some embodiments, the composition is delivered via sub-retinal injection. According to some embodiments, the composition is delivered via intravitreal injection.

Vectors suitable for introduction of transgenes into immune cells (e.g., T-cells) include non-integrating lentivirus vectors. See, e.g., U.S. Patent Publication No. 2009-0117617.

Pharmaceutically acceptable carriers are determined in part by the particular composition being administered, as well as by the particular method used to administer the composition. Accordingly, there is a wide variety of suitable formulations of pharmaceutical compositions available, as described below (See, e.g., Remington's Pharmaceutical Sciences, 17th ed., 1989).

In accordance with some embodiments, there is provided an RNA molecule which binds to/associates with and/or directs the RNA guided DNA nuclease to a sequence comprising at least one nucleotide which differs between a mutated allele and a functional allele (e.g., SNP) of a gene of interest (i.e., a sequence of the mutated allele which is not present in the functional allele). The sequence may be within the disease associated mutation. The sequence may be upstream or downstream to the disease associated mutation. Any sequence difference between the mutated allele and the functional allele may be targeted by an RNA molecule of the present invention to inactivate the mutant allele, or otherwise disable its dominant disease-causing effects, while preserving the activity of the functional allele.

The disclosed compositions and methods may also be used in the manufacture of a medicament for treating dominant genetic disorders in a patient.

Examples of RNA Guide Sequences which Specifically Target Mutated Alleles of BEST1 Gene Although a large number of guide sequences can be designed to target a mutated allele, the nucleotide sequences described in Tables 2 identified by SEQ ID NOs: 1-3010 below were specifically selected to effectively implement the methods set forth herein and to effectively discriminate between alleles.

Referring to columns 1-4, each of SEQ ID NOs. 1-3010 indicated in column 1 corresponds to an engineered guide sequence. The corresponding SNP details are indicated in column 2. The SNP details indicated in the 2nd column include the assigned identifier for each SNP corresponding to a SNP ID indicated in Table 1. Column 3 indicates whether the target of each guide sequence is the BEST1 gene polymorph or wild type (REF) sequence. Column 4 indicates the guanine-cytosine content of each guide sequence.

Table 2 shows guide sequences designed for use as described in the embodiments above to associate with different SNPs within a sequence of a mutated BEST1 allele. Each engineered guide molecule is further designed such as to associate with a target genomic DNA sequence of interest that lies next to a protospacer adjacent motif (PAM), e.g., a PAM matching the sequence NGG or NAG, where "N" is any nucleobase. The guide sequences were designed to work in conjunction with one or more different CRISPR nucleases, including, but not limited to, e.g. SpCas9WT (PAM SEQ: NGG), SpCas9.VQR.1 (PAM SEQ: NGAN), SpCas9.VQR.2 (PAM SEQ: NGNG), SpCas9.EQR (PAM SEQ: NGAG), SpCas9.VRER (PAM SEQ: NGCG), SaCas9WT (PAM SEQ: NNGRRT), NmCas9WT (PAM SEQ: NNNNGATT), Cpf1 (PAM SEQ: TTTV), or JeCas9WT (PAM SEQ: NNNVRYM). RNA molecules of the present invention are each designed to form complexes in conjunction with one or more different CRISPR nucleases and designed to target polynucleotide sequences of interest utilizing one or more different PAM sequences respective to the CRISPR nuclease utilized

TABLE 2

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1 | s1 | BOTH | 45% | 4 | s5 | BOTH | 55% |
| 2 | s1 | BOTH | 45% | 5 | s5 | BOTH | 60% |
| 3 | s2 | BOTH | 70% | 6 | s6 | BOTH | 45% |
| 7 | s6 | BOTH | 50% | 43 | s44 | BOTH | 30% |
| 8 | s6 | BOTH | 50% | 44 | s45 | BOTH | 50% |
| 9 | s8 | BOTH | 45% | 45 | s45 | BOTH | 50% |
| 10 | s9 | BOTH | 50% | 46 | s45 | BOTH | 50% |
| 11 | s9 | BOTH | 55% | 47 | s45 | BOTH | 50% |
| 12 | s12 | BOTH | 65% | 48 | s46, s27 | BOTH, REF | 50% |
| 13 | s13 | BOTH | 60% | 49 | s46, s27 | REF, REF | 50% |
| 14 | s14 | BOTH | 60% | 50 | s48, s47 | REF, BOTH | 65% |
| 15 | s14 | BOTH | 65% | 51 | s48, s47 | BOTH, BOTH | 60% |
| 16 | s15 | BOTH | 75% | 52 | s48, s47 | REF, REF | 65% |
| 17 | s16 | BOTH | 40% | 53 | s48, s47 | REF, REF | 65% |
| 18 | s16 | BOTH | 40% | 54 | s48, s47 | REF, REF | 65% |
| 19 | s17 | BOTH | 55% | 55 | s48, s47 | REF, REF | 70% |
| 20 | s20 | BOTH | 45% | 56 | s48, s47 | REF, REF | 65% |
| 21 | s21, s22 | BOTH, BOTH | 45% | 57 | s48 | BOTH | 55% |
| 22 | s23 | BOTH | 50% | 58 | s51 | BOTH | 45% |
| 23 | s23 | BOTH | 50% | 59 | s52 | BOTH | 45% |
| 24 | s24 | BOTH | 50% | 60 | s52 | BOTH | 65% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 25 | s24 | BOTH | 50% | 61 | s54 | BOTH | 55% |
| 26 | s27 | BOTH | 50% | 62 | s54 | BOTH | 40% |
| 27 | s29 | BOTH | 35% | 63 | s54 | BOTH | 45% |
| 28 | s31 | BOTH | 65% | 64 | s55 | BOTH | 45% |
| 29 | s31 | BOTH | 65% | 65 | s55 | BOTH | 45% |
| 30 | s32 | BOTH | 45% | 66 | s56 | BOTH | 30% |
| 31 | s32 | BOTH | 45% | 67 | s57 | BOTH | 50% |
| 32 | s35 | BOTH | 55% | 68 | s57 | BOTH | 50% |
| 33 | s35 | BOTH | 55% | 69 | s58 | BOTH | 40% |
| 34 | s36 | BOTH | 40% | 70 | s58 | BOTH | 45% |
| 35 | s38 | BOTH | 60% | 71 | s59 | BOTH | 50% |
| 36 | s40 | BOTH | 45% | 72 | s60 | BOTH | 55% |
| 37 | s41 | BOTH | 55% | 73 | s60 | BOTH | 50% |
| 38 | s41 | BOTH | 70% | 74 | s61 | BOTH | 55% |
| 39 | s41 | BOTH | 55% | 75 | s61 | BOTH | 75% |
| 40 | s42 | BOTH | 45% | 76 | s61 | BOTH | 55% |
| 41 | s43 | BOTH | 40% | 77 | s62 | BOTH | 40% |
| 42 | s43 | BOTH | 50% | 78 | s62 | BOTH | 55% |
| 79 | s62 | BOTH | 40% | 115 | s3 | SNP | 60% |
| 80 | s63 | BOTH | 45% | 116 | s3 | SNP | 55% |
| 81 | s63 | BOTH | 55% | 117 | s3 | REF | 55% |
| 82 | s63 | BOTH | 35% | 118 | s3 | SNP | 55% |
| 83 | s65 | BOTH | 50% | 119 | s3 | REF | 55% |
| 84 | s65 | BOTH | 45% | 120 | s3 | REF | 50% |
| 85 | s66 | BOTH | 80% | 121 | s3 | SNP | 50% |
| 86 | s66 | BOTH | 80% | 122 | s4 | REF | 40% |
| 87 | s67 | BOTH | 35% | 123 | s4 | SNP | 45% |
| 88 | s69 | BOTH | 65% | 124 | s4 | REF | 45% |
| 89 | s69 | BOTH | 60% | 125 | s4 | SNP | 50% |
| 90 | s69 | BOTH | 70% | 126 | s4 | SNP | 50% |
| 91 | s71 | BOTH | 70% | 127 | s4 | REF | 45% |
| 92 | s71 | BOTH | 70% | 128 | s4 | SNP | 40% |
| 93 | s72 | BOTH | 40% | 129 | s4 | REF | 35% |
| 94 | s72 | BOTH | 45% | 130 | s5 | SNP | 65% |
| 95 | s73 | BOTH | 60% | 131 | s5 | REF | 65% |
| 96 | s74 | BOTH | 50% | 132 | s5 | REF | 65% |
| 97 | s74 | BOTH | 50% | 133 | s5 | SNP | 65% |
| 98 | s76 | BOTH | 45% | 134 | s5 | SNP | 70% |
| 99 | s76 | BOTH | 40% | 135 | s5 | REF | 70% |
| 100 | s79 | REF | 35% | 136 | s5 | REF | 65% |
| 101 | s80 | SNP | 45% | 137 | s5 | SNP | 65% |
| 102 | s1 | SNP | 45% | 138 | s5 | REF | 65% |
| 103 | s1 | REF | 40% | 139 | s5 | SNP | 65% |
| 104 | s1 | SNP | 50% | 140 | s6 | SNP | 45% |
| 105 | s1 | REF | 45% | 141 | s6 | REF | 40% |
| 106 | s1 | SNP | 45% | 142 | s6 | SNP | 45% |
| 107 | s1 | REF | 40% | 143 | s6 | SNP | 45% |
| 108 | s1 | SNP | 50% | 144 | s6 | REF | 40% |
| 109 | s1 | REF | 45% | 145 | s6 | REF | 40% |
| 110 | s2 | SNP | 65% | 146 | s7 | REF | 55% |
| 111 | s2 | REF | 70% | 147 | s7 | SNP | 50% |
| 112 | s2 | SNP | 55% | 148 | s7 | REF | 45% |
| 113 | s2 | REF | 60% | 149 | s7 | SNP | 40% |
| 114 | s3 | REF | 60% | 150 | s7 | REF | 60% |
| 151 | s7 | SNP | 55% | 187 | s12 | SNP | 70% |
| 152 | s7 | SNP | 50% | 188 | s12 | REF | 65% |
| 153 | s7 | REF | 55% | 189 | s12 | REF | 65% |
| 154 | s7 | REF | 65% | 190 | s12 | REF | 70% |
| 155 | s7 | REF | 55% | 191 | s12 | SNP | 75% |
| 156 | s7 | SNP | 50% | 192 | s12 | SNP | 70% |
| 157 | s7 | SNP | 60% | 193 | s12 | SNP | 70% |
| 158 | s7 | SNP | 50% | 194 | s12 | REF | 65% |
| 159 | s7 | REF | 55% | 195 | s12 | REF | 65% |
| 160 | s7 | SNP | 50% | 196 | s12 | SNP | 70% |
| 161 | s7 | REF | 55% | 197 | s12 | SNP | 65% |
| 162 | s7 | REF | 60% | 198 | s12 | REF | 60% |
| 163 | s7 | SNP | 55% | 199 | s13 | SNP | 65% |
| 164 | s7 | REF | 55% | 200 | s13 | REF | 70% |
| 165 | s7 | SNP | 50% | 201 | s13 | REF | 70% |
| 166 | s8 | SNP | 45% | 202 | s13 | SNP | 65% |
| 167 | s8 | REF | 45% | 203 | s13 | REF | 70% |
| 168 | s8 | SNP | 50% | 204 | s13 | SNP | 65% |
| 169 | s8 | REF | 45% | 205 | s14 | SNP | 65% |
| 170 | s8 | SNP | 50% | 206 | s14 | REF | 60% |
| 171 | s8 | REF | 40% | 207 | s14 | SNP | 55% |
| 172 | s9 | SNP | 50% | 208 | s14 | REF | 50% |
| 173 | s9 | REF | 55% | 209 | s14 | REF | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 174 | s9 | SNP | 65% | 210 | s14 | REF | 65% |
| 175 | s9 | REF | 70% | 211 | s14 | SNP | 55% |
| 176 | s9 | SNP | 55% | 212 | s14 | REF | 60% |
| 177 | s9 | REF | 60% | 213 | s14 | SNP | 70% |
| 178 | s9 | SNP | 60% | 214 | s14 | REF | 65% |
| 179 | s9 | REF | 65% | 215 | s14 | SNP | 55% |
| 180 | s10 | SNP | 35% | 216 | s14 | SNP | 65% |
| 181 | s10 | REF | 40% | 217 | s14 | REF | 60% |
| 182 | s10 | REF | 30% | 218 | s14 | REF | 60% |
| 183 | s10 | REF | 30% | 219 | s14 | SNP | 70% |
| 184 | s11 | REF | 30% | 220 | s14 | REF | 65% |
| 185 | s12 | REF | 65% | 221 | s82 | REF | 45% |
| 186 | s12 | SNP | 70% | 222 | s82 | REF | 55% |
| 223 | s15 | SNP | 85% | 259 | s18 | SNP | 50% |
| 224 | s15 | REF | 85% | 260 | s18 | REF | 55% |
| 225 | s15 | SNP | 80% | 261 | s18 | SNP | 50% |
| 226 | s15 | REF | 80% | 262 | s18 | REF | 55% |
| 227 | s15 | SNP | 70% | 263 | s18 | SNP | 50% |
| 228 | s15 | REF | 70% | 264 | s18 | REF | 55% |
| 229 | s15 | SNP | 70% | 265 | s18 | REF | 50% |
| 230 | s15 | REF | 70% | 266 | s18 | SNP | 45% |
| 231 | s15 | SNP | 75% | 267 | s18 | SNP | 50% |
| 232 | s15 | REF | 75% | 268 | s18 | REF | 55% |
| 233 | s15 | SNP | 80% | 269 | s19 | REF | 45% |
| 234 | s15 | REF | 80% | 270 | s19 | SNP | 40% |
| 235 | s15 | SNP | 65% | 271 | s19 | REF | 50% |
| 236 | s15 | REF | 65% | 272 | s19 | SNP | 45% |
| 237 | s16 | REF | 45% | 273 | s19 | REF | 45% |
| 238 | s16 | SNP | 40% | 274 | s19 | SNP | 40% |
| 239 | s16 | REF | 60% | 275 | s19 | SNP | 45% |
| 240 | s16 | SNP | 55% | 276 | s19 | REF | 50% |
| 241 | s16 | REF | 60% | 277 | s19 | SNP | 55% |
| 242 | s16 | SNP | 55% | 278 | s19 | REF | 60% |
| 243 | s16 | SNP | 55% | 279 | s19 | SNP | 40% |
| 244 | s16 | REF | 60% | 280 | s19 | REF | 45% |
| 245 | s17 | SNP | 60% | 281 | s22 | SNP | 60% |
| 246 | s17 | REF | 65% | 282 | s22 | SNP | 65% |
| 247 | s17 | REF | 65% | 283 | s22 | SNP | 65% |
| 248 | s17 | SNP | 60% | 284 | s23 | REF | 55% |
| 249 | s17 | SNP | 65% | 285 | s23 | SNP | 60% |
| 250 | s17 | REF | 70% | 286 | s23 | REF | 55% |
| 251 | s17 | REF | 55% | 287 | s23 | SNP | 60% |
| 252 | s17 | SNP | 50% | 288 | s23 | SNP | 60% |
| 253 | s17 | REF | 65% | 289 | s23 | REF | 55% |
| 254 | s17 | SNP | 60% | 290 | s23 | SNP | 55% |
| 255 | s17 | REF | 65% | 291 | s23 | REF | 50% |
| 256 | s17 | SNP | 60% | 292 | s24 | SNP | 50% |
| 257 | s18 | REF | 55% | 293 | s24 | REF | 55% |
| 258 | s18 | SNP | 50% | 294 | s24 | REF | 55% |
| 295 | s24 | REF | 55% | 331 | s28 | REF | 50% |
| 296 | s24 | SNP | 50% | 332 | s28 | SNP | 55% |
| 297 | s24 | REF | 50% | 333 | s28 | REF | 55% |
| 298 | s24 | SNP | 45% | 334 | s28 | SNP | 60% |
| 299 | s24 | REF | 55% | 335 | s83 | SNP | 50% |
| 300 | s24 | SNP | 50% | 336 | s29 | REF | 50% |
| 301 | s24 | SNP | 50% | 337 | s29 | SNP | 45% |
| 302 | s25 | SNP | 55% | 338 | s29 | REF | 45% |
| 303 | s25 | REF | 60% | 339 | s29 | SNP | 40% |
| 304 | s25 | REF | 55% | 340 | s29 | SNP | 45% |
| 305 | s25 | REF | 65% | 341 | s29 | REF | 50% |
| 306 | s25 | SNP | 60% | 342 | s29 | SNP | 45% |
| 307 | s25 | SNP | 50% | 343 | s29 | REF | 50% |
| 308 | s25 | REF | 50% | 344 | s29 | SNP | 40% |
| 309 | s25 | SNP | 45% | 345 | s29 | REF | 45% |
| 310 | s26 | REF | 65% | 346 | s30 | SNP | 65% |
| 311 | s26 | SNP | 60% | 347 | s30 | SNP | 65% |
| 312 | s26 | REF | 70% | 348 | s30 | SNP | 75% |
| 313 | s26 | SNP | 65% | 349 | s30 | SNP | 70% |
| 314 | s26 | SNP | 60% | 350 | s30 | SNP | 70% |
| 315 | s26 | REF | 65% | 351 | s31 | SNP | 35% |
| 316 | s26 | SNP | 35% | 352 | s31 | SNP | 40% |
| 317 | s26 | REF | 40% | 353 | s31 | REF | 40% |
| 318 | s26 | SNP | 50% | 354 | s31 | SNP | 60% |
| 319 | s26 | REF | 55% | 355 | s31 | REF | 60% |
| 320 | s26 | SNP | 60% | 356 | s31 | REF | 35% |
| 321 | s26 | REF | 65% | 357 | s84 | REF | 70% |
| 322 | s26 | REF | 65% | 358 | s84 | SNP | 60% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 323 | s26 | SNP | 60% | 359 | s84 | REF | 65% |
| 324 | s26 | SNP | 55% | 360 | s84 | REF | 70% |
| 325 | s26 | REF | 60% | 361 | s32 | REF | 45% |
| 326 | s27 | REF | 50% | 362 | s32 | SNP | 50% |
| 327 | s27 | SNP | 45% | 363 | s32 | REF | 65% |
| 328 | s27 | SNP | 45% | 364 | s32 | SNP | 70% |
| 329 | s28 | SNP | 60% | 365 | s32 | SNP | 60% |
| 330 | s28 | REF | 55% | 366 | s32 | REF | 55% |
| 367 | s32 | REF | 45% | 403 | s37 | REF | 65% |
| 368 | s32 | SNP | 50% | 404 | s37 | REF | 75% |
| 369 | s33 | SNP | 55% | 405 | s37 | REF | 65% |
| 370 | s33 | REF | 60% | 406 | s37 | SNP | 60% |
| 371 | s33 | SNP | 60% | 407 | s37 | REF | 60% |
| 372 | s33 | REF | 65% | 408 | s37 | SNP | 55% |
| 373 | s33 | SNP | 60% | 409 | s37 | SNP | 70% |
| 374 | s33 | REF | 65% | 410 | s37 | REF | 60% |
| 375 | s34 | SNP | 60% | 411 | s37 | SNP | 55% |
| 376 | s34 | REF | 65% | 412 | s85 | SNP | 35% |
| 377 | s34 | SNP | 60% | 413 | s38 | SNP | 50% |
| 378 | s34 | REF | 65% | 414 | s38 | REF | 55% |
| 379 | s34 | REF | 65% | 415 | s38 | SNP | 45% |
| 380 | s34 | SNP | 60% | 416 | s38 | REF | 50% |
| 381 | s35 | REF | 60% | 417 | s38 | REF | 55% |
| 382 | s35 | REF | 65% | 418 | s38 | SNP | 50% |
| 383 | s35 | REF | 65% | 419 | s38 | REF | 50% |
| 384 | s35 | SNP | 60% | 420 | s38 | SNP | 45% |
| 385 | s35 | REF | 60% | 421 | s38 | REF | 50% |
| 386 | s36 | SNP | 55% | 422 | s38 | SNP | 45% |
| 387 | s36 | REF | 50% | 423 | s39 | SNP | 30% |
| 388 | s36 | SNP | 45% | 424 | s39 | SNP | 30% |
| 389 | s36 | REF | 40% | 425 | s39 | SNP | 45% |
| 390 | s36 | REF | 50% | 426 | s39 | REF | 40% |
| 391 | s36 | SNP | 55% | 427 | s39 | SNP | 35% |
| 392 | s36 | REF | 40% | 428 | s39 | REF | 30% |
| 393 | s36 | SNP | 45% | 429 | s39 | SNP | 30% |
| 394 | s37 | REF | 65% | 430 | s40 | SNP | 40% |
| 395 | s37 | SNP | 60% | 431 | s40 | REF | 45% |
| 396 | s37 | SNP | 55% | 432 | s40 | SNP | 40% |
| 397 | s37 | REF | 60% | 433 | s40 | REF | 45% |
| 398 | s37 | SNP | 55% | 434 | s40 | REF | 40% |
| 399 | s37 | REF | 60% | 435 | s40 | SNP | 35% |
| 400 | s37 | REF | 55% | 436 | s40 | SNP | 40% |
| 401 | s37 | SNP | 50% | 437 | s40 | REF | 45% |
| 402 | s37 | SNP | 60% | 438 | s40 | SNP | 35% |
| 439 | s40 | REF | 40% | 475 | s46 | REF | 40% |
| 440 | s41 | REF | 70% | 476 | s46 | SNP | 40% |
| 441 | s41 | SNP | 70% | 477 | s46 | REF | 45% |
| 442 | s41 | REF | 60% | 478 | s46 | SNP | 45% |
| 443 | s41 | REF | 60% | 479 | s46 | SNP | 50% |
| 444 | s41 | REF | 70% | 480 | s46 | REF | 50% |
| 445 | s41 | SNP | 60% | 481 | s46 | SNP | 40% |
| 446 | s41 | REF | 60% | 482 | s46 | REF | 40% |
| 447 | s41 | REF | 60% | 483 | s46 | SNP | 50% |
| 448 | s41 | SNP | 60% | 484 | s46 | SNP | 35% |
| 449 | s41 | REF | 65% | 485 | s46 | REF | 35% |
| 450 | s41 | SNP | 65% | 486 | s47 | SNP | 65% |
| 451 | s41 | SNP | 70% | 487 | s47 | SNP | 65% |
| 452 | s41 | SNP | 65% | 488 | s47 | SNP | 65% |
| 453 | s41 | REF | 65% | 489 | s47 | SNP | 65% |
| 454 | s41 | REF | 65% | 490 | s47 | SNP | 70% |
| 455 | s41 | REF | 70% | 491 | s48 | SNP | 60% |
| 456 | s41 | REF | 70% | 492 | s48 | SNP | 60% |
| 457 | s41 | REF | 65% | 493 | s48 | SNP | 60% |
| 458 | s42 | SNP | 65% | 494 | s48 | SNP | 65% |
| 459 | s42 | REF | 70% | 495 | s48 | SNP | 65% |
| 460 | s42 | SNP | 55% | 496 | s49 | SNP | 55% |
| 461 | s42 | REF | 60% | 497 | s49 | REF | 60% |
| 462 | s42 | REF | 55% | 498 | s50 | REF | 70% |
| 463 | s42 | SNP | 50% | 499 | s50 | SNP | 65% |
| 464 | s43 | SNP | 45% | 500 | s51 | SNP | 55% |
| 465 | s43 | REF | 50% | 501 | s51 | REF | 60% |
| 466 | s43 | SNP | 55% | 502 | s51 | REF | 50% |
| 467 | s43 | REF | 60% | 503 | s51 | SNP | 45% |
| 468 | s43 | SNP | 50% | 504 | s51 | REF | 60% |
| 469 | s43 | REF | 55% | 505 | s51 | SNP | 55% |
| 470 | s43 | SNP | 70% | 506 | s52 | REF | 50% |
| 471 | s43 | SNP | 65% | 507 | s52 | SNP | 45% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 472 | s43 | REF | 70% | 508 | s53 | REF | 35% |
| 473 | s43 | SNP | 60% | 509 | s53 | SNP | 35% |
| 474 | s43 | REF | 65% | 510 | s53 | REF | 30% |
| 511 | s53 | SNP | 30% | 547 | s57 | REF | 30% |
| 512 | s53 | REF | 30% | 548 | s58 | SNP | 40% |
| 513 | s53 | SNP | 30% | 549 | s58 | REF | 45% |
| 514 | s54 | SNP | 45% | 550 | s58 | REF | 45% |
| 515 | s54 | REF | 40% | 551 | s58 | SNP | 40% |
| 516 | s54 | REF | 40% | 552 | s59 | SNP | 60% |
| 517 | s54 | SNP | 45% | 553 | s59 | SNP | 60% |
| 518 | s54 | REF | 40% | 554 | s59 | SNP | 60% |
| 519 | s54 | SNP | 45% | 555 | s59 | SNP | 55% |
| 520 | s54 | REF | 40% | 556 | s60 | REF | 65% |
| 521 | s54 | SNP | 45% | 557 | s60 | SNP | 60% |
| 522 | s54 | SNP | 45% | 558 | s60 | REF | 65% |
| 523 | s54 | REF | 40% | 559 | s60 | SNP | 60% |
| 524 | s55 | SNP | 45% | 560 | s60 | SNP | 50% |
| 525 | s55 | REF | 50% | 561 | s60 | REF | 55% |
| 526 | s55 | SNP | 50% | 562 | s60 | SNP | 50% |
| 527 | s55 | REF | 55% | 563 | s60 | SNP | 55% |
| 528 | s55 | SNP | 40% | 564 | s60 | REF | 60% |
| 529 | s55 | REF | 45% | 565 | s60 | REF | 55% |
| 530 | s55 | SNP | 40% | 566 | s61 | REF | 60% |
| 531 | s55 | REF | 45% | 567 | s61 | SNP | 60% |
| 532 | s56 | SNP | 35% | 568 | s61 | REF | 60% |
| 533 | s56 | REF | 40% | 569 | s61 | REF | 60% |
| 534 | s56 | REF | 40% | 570 | s61 | REF | 55% |
| 535 | s56 | SNP | 35% | 571 | s61 | REF | 75% |
| 536 | s56 | SNP | 40% | 572 | s61 | REF | 60% |
| 537 | s56 | REF | 45% | 573 | s61 | REF | 65% |
| 538 | s56 | REF | 55% | 574 | s61 | SNP | 70% |
| 539 | s56 | SNP | 50% | 575 | s61 | SNP | 55% |
| 540 | s56 | REF | 50% | 576 | s61 | SNP | 75% |
| 541 | s56 | SNP | 45% | 577 | s62 | REF | 55% |
| 542 | s56 | REF | 40% | 578 | s62 | SNP | 50% |
| 543 | s56 | SNP | 35% | 579 | s62 | SNP | 55% |
| 544 | s57 | REF | 30% | 580 | s62 | SNP | 45% |
| 545 | s57 | REF | 35% | 581 | s62 | REF | 50% |
| 546 | s57 | SNP | 30% | 582 | s62 | REF | 55% |
| 583 | s62 | SNP | 50% | 619 | s66 | SNP | 60% |
| 584 | s62 | REF | 55% | 620 | s66 | REF | 65% |
| 585 | s62 | REF | 55% | 621 | s66 | SNP | 60% |
| 586 | s63 | REF | 55% | 622 | s66 | SNP | 60% |
| 587 | s63 | SNP | 50% | 623 | s66 | SNP | 55% |
| 588 | s63 | SNP | 55% | 624 | s67 | SNP | 45% |
| 589 | s63 | REF | 60% | 625 | s67 | REF | 40% |
| 590 | s63 | SNP | 50% | 626 | s67 | REF | 30% |
| 591 | s63 | REF | 55% | 627 | s67 | SNP | 35% |
| 592 | s63 | SNP | 50% | 628 | s67 | REF | 45% |
| 593 | s63 | REF | 55% | 629 | s67 | SNP | 50% |
| 594 | s63 | SNP | 45% | 630 | s68 | SNP | 45% |
| 595 | s63 | REF | 50% | 631 | s68 | REF | 50% |
| 596 | s63 | SNP | 45% | 632 | s68 | REF | 55% |
| 597 | s63 | REF | 50% | 633 | s68 | SNP | 50% |
| 598 | s64 | REF | 45% | 634 | s69 | SNP | 70% |
| 599 | s64 | SNP | 40% | 635 | s69 | REF | 75% |
| 600 | s64 | REF | 55% | 636 | s69 | REF | 75% |
| 601 | s64 | SNP | 50% | 637 | s69 | SNP | 70% |
| 602 | s65 | SNP | 50% | 638 | s69 | REF | 75% |
| 603 | s65 | REF | 45% | 639 | s69 | SNP | 70% |
| 604 | s65 | REF | 45% | 640 | s69 | SNP | 70% |
| 605 | s65 | SNP | 50% | 641 | s69 | REF | 75% |
| 606 | s65 | REF | 45% | 642 | s69 | SNP | 70% |
| 607 | s65 | SNP | 50% | 643 | s69 | SNP | 75% |
| 608 | s66 | SNP | 75% | 644 | s69 | REF | 80% |
| 609 | s66 | REF | 80% | 645 | s69 | REF | 75% |
| 610 | s66 | REF | 60% | 646 | s69 | SNP | 70% |
| 611 | s66 | SNP | 55% | 647 | s69 | REF | 75% |
| 612 | s66 | REF | 60% | 648 | s69 | REF | 75% |
| 613 | s66 | REF | 65% | 649 | s69 | SNP | 70% |
| 614 | s66 | SNP | 60% | 650 | s69 | SNP | 65% |
| 615 | s66 | SNP | 60% | 651 | s69 | REF | 70% |
| 616 | s66 | REF | 65% | 652 | s70 | REF | 35% |
| 617 | s66 | REF | 65% | 653 | s70 | SNP | 30% |
| 618 | s66 | REF | 65% | 654 | s71 | SNP | 80% |
| 655 | s71 | REF | 80% | 691 | s74 | SNP | 40% |
| 656 | s71 | REF | 80% | 692 | s74 | REF | 45% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 657 | s71 | SNP | 80% | 693 | s74 | REF | 50% |
| 658 | s71 | REF | 80% | 694 | s74 | SNP | 45% |
| 659 | s71 | SNP | 80% | 695 | s74 | REF | 55% |
| 660 | s71 | REF | 85% | 696 | s74 | SNP | 40% |
| 661 | s71 | SNP | 85% | 697 | s74 | REF | 45% |
| 662 | s71 | SNP | 70% | 698 | s74 | REF | 45% |
| 663 | s71 | SNP | 75% | 699 | s74 | SNP | 40% |
| 664 | s71 | REF | 75% | 700 | s74 | REF | 45% |
| 665 | s71 | REF | 70% | 701 | s74 | SNP | 40% |
| 666 | s71 | SNP | 75% | 702 | s75 | SNP | 30% |
| 667 | s71 | REF | 75% | 703 | s75 | SNP | 40% |
| 668 | s72 | REF | 45% | 704 | s75 | REF | 35% |
| 669 | s72 | SNP | 40% | 705 | s76 | REF | 50% |
| 670 | s72 | REF | 45% | 706 | s76 | SNP | 45% |
| 671 | s72 | REF | 45% | 707 | s76 | REF | 45% |
| 672 | s72 | REF | 50% | 708 | s76 | SNP | 40% |
| 673 | s72 | SNP | 45% | 709 | s76 | SNP | 40% |
| 674 | s72 | SNP | 40% | 710 | s76 | REF | 45% |
| 675 | s72 | REF | 45% | 711 | s76 | SNP | 40% |
| 676 | s72 | REF | 50% | 712 | s76 | REF | 45% |
| 677 | s72 | SNP | 45% | 713 | s76 | REF | 50% |
| 678 | s73 | REF | 55% | 714 | s76 | SNP | 45% |
| 679 | s73 | SNP | 50% | 715 | s1 | BOTH | 40% |
| 680 | s73 | SNP | 50% | 716 | s1 | BOTH | 40% |
| 681 | s73 | REF | 55% | 717 | s2 | BOTH | 70% |
| 682 | s73 | REF | 60% | 718 | s3 | BOTH | 55% |
| 683 | s73 | SNP | 55% | 719 | s3 | BOTH | 60% |
| 684 | s73 | SNP | 50% | 720 | s3 | BOTH | 50% |
| 685 | s73 | REF | 55% | 721 | s3 | BOTH | 50% |
| 686 | s73 | REF | 55% | 722 | s4 | BOTH | 50% |
| 687 | s73 | SNP | 50% | 723 | s4 | BOTH | 50% |
| 688 | s74 | SNP | 50% | 724 | s4 | BOTH | 50% |
| 689 | s74 | REF | 45% | 725 | s4 | BOTH | 40% |
| 690 | s74 | SNP | 40% | 726 | s5 | BOTH | 60% |
| 727 | s5 | BOTH | 55% | 763 | s19 | BOTH | 55% |
| 728 | s6 | BOTH | 45% | 764 | s19 | BOTH | 60% |
| 729 | s7 | BOTH | 60% | 765 | s19 | BOTH | 40% |
| 730 | s7 | BOTH | 60% | 766 | s21, s22 | BOTH, BOTH | 55% |
| 731 | s8 | BOTH | 50% | 767 | s21, s22 | REF, REF | 60% |
| 732 | s8 | BOTH | 50% | 768 | s21, s22 | REF, REF | 65% |
| 733 | s8 | BOTH | 50% | 769 | s21, s22 | REF, REF | 65% |
| 734 | s9 | BOTH | 65% | 770 | s21, s22 | REF, REF | 65% |
| 735 | s9 | BOTH | 60% | 771 | s21, s22 | REF, REF | 70% |
| 736 | s10 | BOTH | 40% | 772 | s21, s22 | REF, REF | 60% |
| 737 | s10 | BOTH | 35% | 773 | s21, s22 | REF, REF | 70% |
| 738 | s11 | BOTH | 45% | 774 | s21, s22 | REF, REF | 65% |
| 739 | s12 | BOTH | 45% | 775 | s23 | BOTH | 55% |
| 740 | s12 | BOTH | 50% | 776 | s23 | BOTH | 55% |
| 741 | s12 | BOTH | 65% | 777 | s24 | BOTH | 60% |
| 742 | s13 | BOTH | 70% | 778 | s24 | BOTH | 65% |
| 743 | s13 | BOTH | 60% | 779 | s25 | BOTH | 60% |
| 744 | s13 | BOTH | 55% | 780 | s25 | BOTH | 60% |
| 745 | s14 | BOTH | 50% | 781 | s26 | BOTH | 60% |
| 746 | s14 | BOTH | 60% | 782 | s26 | BOTH | 35% |
| 747 | s14 | BOTH | 50% | 783 | s27 | BOTH | 50% |
| 748 | s14 | BOTH | 65% | 784 | s28 | BOTH | 60% |
| 749 | s14 | BOTH | 50% | 785 | s28 | BOTH | 55% |
| 750 | s15 | BOTH | 70% | 786 | s28 | BOTH | 55% |
| 751 | s15 | BOTH | 65% | 787 | s28 | BOTH | 45% |
| 752 | s15 | BOTH | 75% | 788 | s29 | BOTH | 50% |
| 753 | s16 | BOTH | 70% | 789 | s29 | BOTH | 45% |
| 754 | s16 | BOTH | 60% | 790 | s29 | BOTH | 40% |
| 755 | s17 | BOTH | 60% | 791 | s30 | BOTH | 60% |
| 756 | s17 | BOTH | 65% | 792 | s30 | BOTH | 60% |
| 757 | s17 | BOTH | 50% | 793 | s31 | BOTH | 40% |
| 758 | s18 | BOTH | 50% | 794 | s31 | BOTH | 35% |
| 759 | s18 | BOTH | 50% | 795 | s32 | BOTH | 70% |
| 760 | s18 | BOTH | 55% | 796 | s32 | BOTH | 65% |
| 761 | s18 | BOTH | 50% | 797 | s33 | BOTH | 50% |
| 762 | s19 | BOTH | 40% | 798 | s33 | BOTH | 60% |
| 799 | s34 | BOTH | 50% | 835 | s41 | BOTH | 65% |
| 800 | s34 | BOTH | 55% | 836 | s41 | BOTH | 50% |
| 801 | s34 | BOTH | 70% | 837 | s41 | BOTH | 50% |
| 802 | s34 | BOTH | 70% | 838 | s42 | BOTH | 75% |
| 803 | s35 | BOTH | 55% | 839 | s42 | BOTH | 75% |
| 804 | s35 | BOTH | 55% | 840 | s42 | BOTH | 40% |
| 805 | s35 | BOTH | 55% | 841 | s44 | BOTH | 35% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 806 | s35 | BOTH | 50% | 842 | s44 | BOTH | 35% |
| 807 | s35 | BOTH | 50% | 843 | s44 | BOTH | 40% |
| 808 | s35 | BOTH | 60% | 844 | s44 | BOTH | 30% |
| 809 | s35 | BOTH | 55% | 845 | s44 | BOTH | 40% |
| 810 | s35 | BOTH | 50% | 846 | s44 | BOTH | 35% |
| 811 | s35 | BOTH | 50% | 847 | s44 | BOTH | 35% |
| 812 | s35 | BOTH | 60% | 848 | s45 | BOTH | 50% |
| 813 | s35 | BOTH | 55% | 849 | s45 | BOTH | 55% |
| 814 | s35 | BOTH | 60% | 850 | s45 | BOTH | 50% |
| 815 | s35 | BOTH | 65% | 851 | s45 | BOTH | 50% |
| 816 | s35 | BOTH | 55% | 852 | s45 | BOTH | 50% |
| 817 | s35 | BOTH | 55% | 853 | s45 | BOTH | 55% |
| 818 | s36 | BOTH | 45% | 854 | s45 | BOTH | 50% |
| 819 | s36 | BOTH | 40% | 855 | s45 | BOTH | 55% |
| 820 | s36 | BOTH | 40% | 856 | s45 | BOTH | 55% |
| 821 | s37 | BOTH | 65% | 857 | s45 | BOTH | 55% |
| 822 | s37 | BOTH | 80% | 858 | s45 | BOTH | 55% |
| 823 | s37 | BOTH | 75% | 859 | s45 | BOTH | 50% |
| 824 | s37 | BOTH | 65% | 860 | s45 | BOTH | 50% |
| 825 | s38 | BOTH | 50% | 861 | s45 | BOTH | 50% |
| 826 | s38 | BOTH | 55% | 862 | s46, s27 | REF, BOTH | 50% |
| 827 | s38 | BOTH | 55% | 863 | s46, s27 | REF, BOTH | 45% |
| 828 | s39 | BOTH | 45% | 864 | s46, s27 | BOTH, REF | 55% |
| 829 | s39 | BOTH | 35% | 865 | s46, s27 | REF, REF | 50% |
| 830 | s40 | BOTH | 45% | 866 | s46 | BOTH | 35% |
| 831 | s40 | BOTH | 45% | 867 | s46 | BOTH | 35% |
| 832 | s40 | BOTH | 50% | 868 | s47 | BOTH | 55% |
| 833 | s41 | BOTH | 70% | 869 | s48, s47 | REF, BOTH | 65% |
| 834 | s41 | BOTH | 65% | 870 | s48, s47 | REF, REF | 65% |
| 871 | s48, s47 | REF, REF | 70% | 907 | s63 | BOTH | 60% |
| 872 | s48, s47 | REF, REF | 70% | 908 | s64 | BOTH | 60% |
| 873 | s48, s47 | REF, REF | 65% | 909 | s64 | BOTH | 55% |
| 874 | s48, s47 | REF, REF | 65% | 910 | s65 | BOTH | 50% |
| 875 | s48, s47 | REF, REF | 65% | 911 | s65 | BOTH | 40% |
| 876 | s48, s47 | REF, REF | 65% | 912 | s66 | BOTH | 65% |
| 877 | s48, s47 | REF, REF | 60% | 913 | s66 | BOTH | 60% |
| 878 | s48, s47 | REF, REF | 70% | 914 | s67 | BOTH | 30% |
| 879 | s48, s47 | REF, REF | 70% | 915 | s67 | BOTH | 45% |
| 880 | s48, s47 | REF, REF | 75% | 916 | s67 | BOTH | 45% |
| 881 | s48, s47 | REF, REF | 75% | 917 | s68 | BOTH | 45% |
| 882 | s48, s47 | REF, REF | 70% | 918 | s68 | BOTH | 50% |
| 883 | s48, s47 | REF, REF | 65% | 919 | s68 | BOTH | 55% |
| 884 | s49 | BOTH | 55% | 920 | s68 | BOTH | 55% |
| 885 | s50 | BOTH | 60% | 921 | s69 | BOTH | 65% |
| 886 | s50 | BOTH | 60% | 922 | s70 | BOTH | 35% |
| 887 | s52 | BOTH | 45% | 923 | s70 | BOTH | 45% |
| 888 | s52 | BOTH | 70% | 924 | s70 | BOTH | 45% |
| 889 | s53 | BOTH | 55% | 925 | s70 | BOTH | 45% |
| 890 | s53 | BOTH | 55% | 926 | s71 | BOTH | 60% |
| 891 | s54 | BOTH | 60% | 927 | s71 | BOTH | 65% |
| 892 | s55 | BOTH | 45% | 928 | s72 | BOTH | 40% |
| 893 | s55 | BOTH | 35% | 929 | s72 | BOTH | 50% |
| 894 | s56 | BOTH | 30% | 930 | s72 | BOTH | 45% |
| 895 | s56 | BOTH | 55% | 931 | s72 | BOTH | 40% |
| 896 | s56 | BOTH | 50% | 932 | s73 | BOTH | 60% |
| 897 | s57 | BOTH | 40% | 933 | s73 | BOTH | 60% |
| 898 | s57 | BOTH | 35% | 934 | s73 | BOTH | 65% |
| 899 | s58 | BOTH | 45% | 935 | s74 | BOTH | 45% |
| 900 | s58 | BOTH | 50% | 936 | s74 | BOTH | 45% |
| 901 | s59 | BOTH | 50% | 937 | s75 | BOTH | 50% |
| 902 | s60 | BOTH | 65% | 938 | s75 | BOTH | 55% |
| 903 | s60 | BOTH | 65% | 939 | s75 | BOTH | 30% |
| 904 | s61 | BOTH | 80% | 940 | s76 | BOTH | 35% |
| 905 | s61 | BOTH | 80% | 941 | s76 | BOTH | 50% |
| 906 | s62 | BOTH | 50% | 942 | s77 | BOTH | 65% |
| 943 | s77 | BOTH | 70% | 979 | s1 | SNP | 50% |
| 944 | s77 | BOTH | 30% | 980 | s1 | REF | 45% |
| 945 | s78 | BOTH | 40% | 981 | s1 | REF | 40% |
| 946 | s78 | BOTH | 30% | 982 | s1 | SNP | 45% |
| 947 | s78 | BOTH | 30% | 983 | s1 | REF | 45% |
| 948 | s79 | REF | 30% | 984 | s1 | SNP | 50% |
| 949 | s79 | REF | 40% | 985 | s1 | SNP | 55% |
| 950 | s79 | REF | 30% | 986 | s1 | REF | 50% |
| 951 | s79 | REF | 35% | 987 | s1 | REF | 50% |
| 952 | s80 | SNP | 45% | 988 | s1 | SNP | 55% |
| 953 | s80 | SNP | 35% | 989 | s1 | REF | 50% |
| 954 | s80 | SNP | 45% | 990 | s1 | REF | 35% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 955 | s80 | SNP | 45% | 991 | s1 | SNP | 40% |
| 956 | s80 | SNP | 45% | 992 | s81 | SNP | 50% |
| 957 | s80 | SNP | 45% | 993 | s2 | REF | 70% |
| 958 | s80 | SNP | 40% | 994 | s2 | SNP | 65% |
| 959 | s80 | SNP | 40% | 995 | s2 | SNP | 60% |
| 960 | s1 | REF | 45% | 996 | s2 | REF | 65% |
| 961 | s1 | SNP | 50% | 997 | s2 | SNP | 50% |
| 962 | s1 | SNP | 50% | 998 | s2 | REF | 55% |
| 963 | s1 | REF | 45% | 999 | s2 | REF | 65% |
| 964 | s1 | REF | 50% | 1000 | s2 | SNP | 60% |
| 965 | s1 | SNP | 55% | 1001 | s2 | REF | 60% |
| 966 | s1 | SNP | 40% | 1002 | s2 | SNP | 55% |
| 967 | s1 | REF | 35% | 1003 | s2 | SNP | 55% |
| 968 | s1 | REF | 45% | 1004 | s2 | REF | 60% |
| 969 | s1 | SNP | 50% | 1005 | s3 | SNP | 60% |
| 970 | s1 | REF | 40% | 1006 | s3 | REF | 60% |
| 971 | s1 | SNP | 45% | 1007 | s3 | REF | 55% |
| 972 | s1 | REF | 45% | 1008 | s3 | SNP | 50% |
| 973 | s1 | REF | 50% | 1009 | s3 | REF | 50% |
| 974 | s1 | SNP | 55% | 1010 | s3 | SNP | 65% |
| 975 | s1 | SNP | 50% | 1011 | s3 | REF | 65% |
| 976 | s1 | SNP | 55% | 1012 | s3 | SNP | 65% |
| 977 | s1 | SNP | 55% | 1013 | s3 | REF | 65% |
| 978 | s1 | REF | 50% | 1014 | s3 | REF | 65% |
| 1015 | s3 | SNP | 65% | 1051 | s4 | SNP | 50% |
| 1016 | s3 | SNP | 55% | 1052 | s4 | REF | 40% |
| 1017 | s3 | REF | 55% | 1053 | s4 | REF | 50% |
| 1018 | s3 | REF | 55% | 1054 | s4 | REF | 45% |
| 1019 | s3 | SNP | 55% | 1055 | s4 | SNP | 50% |
| 1020 | s3 | REF | 55% | 1056 | s4 | SNP | 50% |
| 1021 | s3 | REF | 60% | 1057 | s4 | REF | 45% |
| 1022 | s3 | SNP | 60% | 1058 | s4 | SNP | 45% |
| 1023 | s3 | SNP | 60% | 1059 | s4 | SNP | 45% |
| 1024 | s3 | SNP | 55% | 1060 | s4 | REF | 40% |
| 1025 | s3 | REF | 55% | 1061 | s4 | REF | 35% |
| 1026 | s3 | SNP | 55% | 1062 | s4 | SNP | 40% |
| 1027 | s3 | REF | 55% | 1063 | s4 | REF | 40% |
| 1028 | s3 | SNP | 55% | 1064 | s4 | SNP | 45% |
| 1029 | s3 | REF | 65% | 1065 | s4 | SNP | 45% |
| 1030 | s3 | SNP | 65% | 1066 | s4 | REF | 40% |
| 1031 | s3 | REF | 60% | 1067 | s4 | SNP | 45% |
| 1032 | s3 | SNP | 60% | 1068 | s4 | REF | 40% |
| 1033 | s3 | REF | 60% | 1069 | s5 | SNP | 60% |
| 1034 | s3 | SNP | 60% | 1070 | s5 | REF | 60% |
| 1035 | s3 | REF | 60% | 1071 | s5 | SNP | 65% |
| 1036 | s3 | SNP | 55% | 1072 | s5 | REF | 65% |
| 1037 | s4 | SNP | 50% | 1073 | s5 | REF | 65% |
| 1038 | s4 | REF | 45% | 1074 | s5 | REF | 70% |
| 1039 | s4 | REF | 50% | 1075 | s5 | SNP | 70% |
| 1040 | s4 | SNP | 55% | 1076 | s5 | SNP | 65% |
| 1041 | s4 | REF | 40% | 1077 | s5 | SNP | 65% |
| 1042 | s4 | SNP | 45% | 1078 | s5 | SNP | 65% |
| 1043 | s4 | SNP | 55% | 1079 | s5 | REF | 65% |
| 1044 | s4 | SNP | 50% | 1080 | s5 | REF | 65% |
| 1045 | s4 | REF | 45% | 1081 | s5 | SNP | 65% |
| 1046 | s4 | SNP | 45% | 1082 | s5 | SNP | 65% |
| 1047 | s4 | REF | 40% | 1083 | s5 | REF | 65% |
| 1048 | s4 | REF | 45% | 1084 | s5 | SNP | 65% |
| 1049 | s4 | SNP | 50% | 1085 | s5 | REF | 65% |
| 1050 | s4 | REF | 45% | 1086 | s5 | SNP | 65% |
| 1087 | s5 | REF | 65% | 1123 | s6 | REF | 50% |
| 1088 | s5 | REF | 65% | 1124 | s6 | SNP | 55% |
| 1089 | s5 | REF | 60% | 1125 | s6 | REF | 40% |
| 1090 | s5 | SNP | 60% | 1126 | s6 | SNP | 45% |
| 1091 | s5 | SNP | 60% | 1127 | s6 | REF | 40% |
| 1092 | s5 | REF | 60% | 1128 | s6 | SNP | 45% |
| 1093 | s5 | REF | 60% | 1129 | s6 | SNP | 45% |
| 1094 | s5 | SNP | 60% | 1130 | s6 | REF | 40% |
| 1095 | s5 | REF | 65% | 1131 | s6 | REF | 40% |
| 1096 | s5 | SNP | 65% | 1132 | s6 | SNP | 45% |
| 1097 | s5 | REF | 65% | 1133 | s7 | SNP | 55% |
| 1098 | s5 | SNP | 65% | 1134 | s7 | SNP | 40% |
| 1099 | s6 | REF | 40% | 1135 | s7 | REF | 45% |
| 1100 | s6 | SNP | 45% | 1136 | s7 | REF | 55% |
| 1101 | s6 | SNP | 50% | 1137 | s7 | SNP | 50% |
| 1102 | s6 | REF | 45% | 1138 | s7 | REF | 55% |
| 1103 | s6 | REF | 40% | 1139 | s7 | SNP | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1104 | s6 | SNP | 45% | 1140 | s7 | SNP | 45% |
| 1105 | s6 | SNP | 45% | 1141 | s7 | REF | 50% |
| 1106 | s6 | REF | 40% | 1142 | s7 | SNP | 50% |
| 1107 | s6 | REF | 50% | 1143 | s7 | REF | 55% |
| 1108 | s6 | SNP | 55% | 1144 | s7 | REF | 50% |
| 1109 | s6 | SNP | 55% | 1145 | s7 | SNP | 45% |
| 1110 | s6 | REF | 50% | 1146 | s7 | SNP | 60% |
| 1111 | s6 | REF | 45% | 1147 | s7 | REF | 65% |
| 1112 | s6 | SNP | 50% | 1148 | s7 | SNP | 55% |
| 1113 | s6 | REF | 40% | 1149 | s7 | SNP | 50% |
| 1114 | s6 | SNP | 45% | 1150 | s7 | REF | 55% |
| 1115 | s6 | SNP | 55% | 1151 | s8 | REF | 45% |
| 1116 | s6 | REF | 50% | 1152 | s8 | REF | 35% |
| 1117 | s6 | REF | 50% | 1153 | s8 | SNP | 40% |
| 1118 | s6 | SNP | 55% | 1154 | s8 | REF | 40% |
| 1119 | s6 | SNP | 45% | 1155 | s8 | SNP | 45% |
| 1120 | s6 | REF | 40% | 1156 | s8 | REF | 40% |
| 1121 | s6 | SNP | 55% | 1157 | s8 | SNP | 45% |
| 1122 | s6 | REF | 50% | 1158 | s8 | SNP | 50% |
| 1159 | s8 | REF | 45% | 1195 | s9 | REF | 70% |
| 1160 | s8 | SNP | 50% | 1196 | s9 | SNP | 65% |
| 1161 | s8 | SNP | 50% | 1197 | s9 | REF | 65% |
| 1162 | s8 | REF | 45% | 1198 | s9 | SNP | 60% |
| 1163 | s8 | SNP | 45% | 1199 | s9 | REF | 60% |
| 1164 | s8 | REF | 40% | 1200 | s9 | SNP | 55% |
| 1165 | s8 | REF | 35% | 1201 | s9 | REF | 55% |
| 1166 | s8 | SNP | 40% | 1202 | s9 | SNP | 60% |
| 1167 | s8 | SNP | 50% | 1203 | s9 | REF | 65% |
| 1168 | s8 | REF | 45% | 1204 | s9 | REF | 70% |
| 1169 | s8 | SNP | 45% | 1205 | s9 | SNP | 65% |
| 1170 | s8 | REF | 40% | 1206 | s9 | SNP | 65% |
| 1171 | s8 | SNP | 45% | 1207 | s9 | REF | 70% |
| 1172 | s8 | REF | 40% | 1208 | s9 | REF | 65% |
| 1173 | s8 | REF | 40% | 1209 | s9 | SNP | 60% |
| 1174 | s8 | SNP | 45% | 1210 | s9 | REF | 65% |
| 1175 | s8 | SNP | 40% | 1211 | s9 | SNP | 60% |
| 1176 | s8 | REF | 35% | 1212 | s9 | REF | 65% |
| 1177 | s8 | SNP | 40% | 1213 | s9 | SNP | 60% |
| 1178 | s8 | REF | 35% | 1214 | s9 | SNP | 50% |
| 1179 | s8 | SNP | 50% | 1215 | s9 | SNP | 55% |
| 1180 | s8 | REF | 45% | 1216 | s9 | REF | 60% |
| 1181 | s8 | SNP | 50% | 1217 | s10 | REF | 30% |
| 1182 | s8 | REF | 45% | 1218 | s10 | SNP | 30% |
| 1183 | s8 | REF | 40% | 1219 | s10 | REF | 35% |
| 1184 | s8 | SNP | 45% | 1220 | s10 | REF | 40% |
| 1185 | s9 | SNP | 60% | 1221 | s10 | SNP | 35% |
| 1186 | s9 | REF | 65% | 1222 | s10 | REF | 30% |
| 1187 | s9 | REF | 60% | 1223 | s10 | REF | 30% |
| 1188 | s9 | SNP | 55% | 1224 | s10 | SNP | 30% |
| 1189 | s9 | REF | 55% | 1225 | s10 | REF | 35% |
| 1190 | s9 | SNP | 50% | 1226 | s10 | REF | 35% |
| 1191 | s9 | SNP | 60% | 1227 | s10 | SNP | 30% |
| 1192 | s9 | REF | 65% | 1228 | s10 | REF | 35% |
| 1193 | s9 | SNP | 50% | 1229 | s10 | REF | 30% |
| 1194 | s9 | REF | 55% | 1230 | s10 | SNP | 30% |
| 1231 | s11 | SNP | 45% | 1267 | s12 | REF | 65% |
| 1232 | s11 | SNP | 45% | 1268 | s12 | REF | 65% |
| 1233 | s11 | REF | 50% | 1269 | s12 | SNP | 70% |
| 1234 | s11 | SNP | 50% | 1270 | s12 | REF | 65% |
| 1235 | s11 | REF | 55% | 1271 | s12 | SNP | 70% |
| 1236 | s11 | SNP | 45% | 1272 | s12 | SNP | 70% |
| 1237 | s11 | REF | 50% | 1273 | s12 | REF | 65% |
| 1238 | s11 | SNP | 40% | 1274 | s12 | REF | 55% |
| 1239 | s11 | REF | 45% | 1275 | s12 | SNP | 60% |
| 1240 | s11 | REF | 50% | 1276 | s12 | SNP | 60% |
| 1241 | s11 | SNP | 45% | 1277 | s12 | SNP | 70% |
| 1242 | s11 | REF | 35% | 1278 | s12 | REF | 65% |
| 1243 | s11 | SNP | 30% | 1279 | s12 | SNP | 75% |
| 1244 | s11 | REF | 50% | 1280 | s12 | REF | 70% |
| 1245 | s11 | SNP | 45% | 1281 | s12 | REF | 55% |
| 1246 | s11 | REF | 45% | 1282 | s12 | REF | 60% |
| 1247 | s11 | SNP | 40% | 1283 | s12 | SNP | 65% |
| 1248 | s11 | REF | 55% | 1284 | s13 | SNP | 70% |
| 1249 | s11 | SNP | 50% | 1285 | s13 | SNP | 65% |
| 1250 | s11 | REF | 50% | 1286 | s13 | REF | 70% |
| 1251 | s11 | SNP | 45% | 1287 | s13 | SNP | 70% |
| 1252 | s11 | REF | 40% | 1288 | s13 | REF | 75% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1253 | s11 | SNP | 35% | 1289 | s13 | SNP | 65% |
| 1254 | s11 | SNP | 35% | 1290 | s13 | REF | 70% |
| 1255 | s11 | REF | 40% | 1291 | s13 | REF | 70% |
| 1256 | s11 | SNP | 30% | 1292 | s13 | SNP | 65% |
| 1257 | s11 | REF | 35% | 1293 | s13 | SNP | 65% |
| 1258 | s12 | REF | 60% | 1294 | s13 | REF | 70% |
| 1259 | s12 | SNP | 65% | 1295 | s13 | REF | 70% |
| 1260 | s12 | SNP | 70% | 1296 | s13 | SNP | 65% |
| 1261 | s12 | REF | 65% | 1297 | s13 | SNP | 70% |
| 1262 | s12 | REF | 65% | 1298 | s13 | REF | 75% |
| 1263 | s12 | SNP | 70% | 1299 | s13 | SNP | 70% |
| 1264 | s12 | SNP | 65% | 1300 | s13 | REF | 75% |
| 1265 | s12 | REF | 60% | 1301 | s13 | SNP | 60% |
| 1266 | s12 | SNP | 70% | 1302 | s13 | REF | 65% |
| 1303 | s13 | REF | 75% | 1339 | s14 | SNP | 65% |
| 1304 | s13 | REF | 65% | 1340 | s14 | SNP | 65% |
| 1305 | s13 | REF | 75% | 1341 | s14 | REF | 60% |
| 1306 | s13 | SNP | 70% | 1342 | s14 | REF | 60% |
| 1307 | s13 | REF | 75% | 1343 | s14 | SNP | 65% |
| 1308 | s13 | SNP | 70% | 1344 | s14 | REF | 60% |
| 1309 | s13 | REF | 75% | 1345 | s14 | SNP | 65% |
| 1310 | s13 | SNP | 70% | 1346 | s14 | REF | 60% |
| 1311 | s13 | SNP | 60% | 1347 | s14 | REF | 60% |
| 1312 | s13 | REF | 70% | 1348 | s14 | REF | 50% |
| 1313 | s13 | SNP | 65% | 1349 | s14 | REF | 65% |
| 1314 | s13 | SNP | 65% | 1350 | s14 | REF | 60% |
| 1315 | s13 | REF | 70% | 1351 | s14 | SNP | 65% |
| 1316 | s13 | REF | 75% | 1352 | s14 | REF | 65% |
| 1317 | s13 | SNP | 70% | 1353 | s14 | REF | 65% |
| 1318 | s14 | SNP | 60% | 1354 | s14 | REF | 65% |
| 1319 | s14 | REF | 55% | 1355 | s14 | SNP | 70% |
| 1320 | s14 | SNP | 55% | 1356 | s14 | REF | 55% |
| 1321 | s14 | REF | 50% | 1357 | s14 | REF | 65% |
| 1322 | s14 | REF | 55% | 1358 | s14 | REF | 60% |
| 1323 | s14 | REF | 55% | 1359 | s14 | REF | 60% |
| 1324 | s14 | REF | 50% | 1360 | s14 | REF | 60% |
| 1325 | s14 | SNP | 65% | 1361 | s82 | REF | 30% |
| 1326 | s14 | REF | 60% | 1362 | s82 | REF | 40% |
| 1327 | s14 | REF | 65% | 1363 | s82 | REF | 65% |
| 1328 | s14 | SNP | 70% | 1364 | s82 | REF | 45% |
| 1329 | s14 | SNP | 70% | 1365 | s82 | REF | 60% |
| 1330 | s14 | REF | 65% | 1366 | s82 | REF | 60% |
| 1331 | s14 | REF | 55% | 1367 | s82 | REF | 30% |
| 1332 | s14 | SNP | 60% | 1368 | s82 | SNP | 30% |
| 1333 | s14 | REF | 65% | 1369 | s82 | REF | 55% |
| 1334 | s14 | REF | 55% | 1370 | s82 | REF | 40% |
| 1335 | s14 | REF | 65% | 1371 | s15 | REF | 65% |
| 1336 | s14 | SNP | 70% | 1372 | s15 | SNP | 65% |
| 1337 | s14 | REF | 60% | 1373 | s15 | REF | 80% |
| 1338 | s14 | REF | 60% | 1374 | s15 | SNP | 80% |
| 1375 | s15 | REF | 70% | 1411 | s16 | REF | 50% |
| 1376 | s15 | SNP | 70% | 1412 | s16 | SNP | 60% |
| 1377 | s15 | REF | 70% | 1413 | s16 | REF | 65% |
| 1378 | s15 | SNP | 70% | 1414 | s16 | REF | 65% |
| 1379 | s15 | REF | 75% | 1415 | s16 | SNP | 60% |
| 1380 | s15 | SNP | 75% | 1416 | s16 | SNP | 60% |
| 1381 | s15 | REF | 85% | 1417 | s16 | REF | 65% |
| 1382 | s15 | SNP | 85% | 1418 | s16 | REF | 60% |
| 1383 | s15 | REF | 80% | 1419 | s16 | SNP | 55% |
| 1384 | s15 | SNP | 80% | 1420 | s16 | SNP | 55% |
| 1385 | s15 | REF | 80% | 1421 | s16 | REF | 60% |
| 1386 | s15 | REF | 75% | 1422 | s16 | REF | 65% |
| 1387 | s15 | SNP | 75% | 1423 | s16 | SNP | 60% |
| 1388 | s15 | REF | 70% | 1424 | s16 | REF | 50% |
| 1389 | s15 | SNP | 70% | 1425 | s16 | SNP | 45% |
| 1390 | s15 | SNP | 80% | 1426 | s16 | SNP | 60% |
| 1391 | s15 | SNP | 75% | 1427 | s16 | REF | 55% |
| 1392 | s15 | REF | 75% | 1428 | s16 | SNP | 50% |
| 1393 | s15 | SNP | 80% | 1429 | s17 | SNP | 60% |
| 1394 | s15 | REF | 80% | 1430 | s17 | REF | 65% |
| 1395 | s15 | SNP | 70% | 1431 | s17 | SNP | 60% |
| 1396 | s15 | REF | 70% | 1432 | s17 | SNP | 60% |
| 1397 | s16 | SNP | 55% | 1433 | s17 | REF | 65% |
| 1398 | s16 | REF | 60% | 1434 | s17 | REF | 65% |
| 1399 | s16 | REF | 60% | 1435 | s17 | SNP | 50% |
| 1400 | s16 | SNP | 55% | 1436 | s17 | REF | 55% |
| 1401 | s16 | SNP | 40% | 1437 | s17 | REF | 65% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1402 | s16 | REF | 45% | 1438 | s17 | SNP | 60% |
| 1403 | s16 | SNP | 45% | 1439 | s17 | SNP | 60% |
| 1404 | s16 | SNP | 55% | 1440 | s17 | REF | 65% |
| 1405 | s16 | REF | 60% | 1441 | s17 | SNP | 60% |
| 1406 | s16 | SNP | 50% | 1442 | s17 | REF | 65% |
| 1407 | s16 | REF | 55% | 1443 | s17 | SNP | 45% |
| 1408 | s16 | SNP | 60% | 1444 | s17 | REF | 50% |
| 1409 | s16 | REF | 65% | 1445 | s17 | REF | 70% |
| 1410 | s16 | REF | 65% | 1446 | s17 | SNP | 65% |
| 1447 | s17 | REF | 65% | 1483 | s18 | REF | 55% |
| 1448 | s17 | SNP | 60% | 1484 | s18 | SNP | 50% |
| 1449 | s17 | REF | 50% | 1485 | s19 | REF | 50% |
| 1450 | s17 | SNP | 60% | 1486 | s19 | SNP | 45% |
| 1451 | s17 | REF | 65% | 1487 | s19 | REF | 50% |
| 1452 | s17 | REF | 65% | 1488 | s19 | SNP | 45% |
| 1453 | s17 | SNP | 60% | 1489 | s19 | REF | 60% |
| 1454 | s17 | SNP | 45% | 1490 | s19 | SNP | 55% |
| 1455 | s17 | SNP | 60% | 1491 | s19 | REF | 55% |
| 1456 | s17 | REF | 65% | 1492 | s19 | SNP | 50% |
| 1457 | s18 | REF | 55% | 1493 | s19 | REF | 45% |
| 1458 | s18 | SNP | 50% | 1494 | s19 | REF | 50% |
| 1459 | s18 | REF | 55% | 1495 | s19 | SNP | 45% |
| 1460 | s18 | SNP | 50% | 1496 | s19 | SNP | 40% |
| 1461 | s18 | REF | 55% | 1497 | s19 | REF | 45% |
| 1462 | s18 | SNP | 50% | 1498 | s19 | SNP | 55% |
| 1463 | s18 | REF | 50% | 1499 | s19 | SNP | 45% |
| 1464 | s18 | SNP | 45% | 1500 | s19 | REF | 50% |
| 1465 | s18 | SNP | 45% | 1501 | s19 | REF | 60% |
| 1466 | s18 | REF | 50% | 1502 | s19 | SNP | 55% |
| 1467 | s18 | SNP | 45% | 1503 | s19 | REF | 60% |
| 1468 | s18 | SNP | 50% | 1504 | s19 | SNP | 45% |
| 1469 | s18 | REF | 55% | 1505 | s19 | REF | 50% |
| 1470 | s18 | SNP | 45% | 1506 | s19 | SNP | 40% |
| 1471 | s18 | REF | 55% | 1507 | s19 | REF | 45% |
| 1472 | s18 | SNP | 50% | 1508 | s19 | SNP | 50% |
| 1473 | s18 | REF | 55% | 1509 | s19 | REF | 55% |
| 1474 | s18 | SNP | 50% | 1510 | s19 | SNP | 40% |
| 1475 | s18 | REF | 50% | 1511 | s19 | SNP | 45% |
| 1476 | s18 | SNP | 45% | 1512 | s19 | REF | 50% |
| 1477 | s18 | REF | 50% | 1513 | s20 | REF | 45% |
| 1478 | s18 | REF | 55% | 1514 | s22 | SNP | 65% |
| 1479 | s18 | SNP | 50% | 1515 | s22 | SNP | 65% |
| 1480 | s18 | REF | 55% | 1516 | s22 | SNP | 65% |
| 1481 | s18 | SNP | 50% | 1517 | s22 | SNP | 70% |
| 1482 | s18 | REF | 50% | 1518 | s22 | SNP | 60% |
| 1519 | s21 | SNP | 65% | 1555 | s23 | REF | 55% |
| 1520 | s21 | SNP | 70% | 1556 | s23 | REF | 50% |
| 1521 | s21 | SNP | 70% | 1557 | s23 | REF | 50% |
| 1522 | s21 | SNP | 70% | 1558 | s23 | SNP | 55% |
| 1523 | s21 | SNP | 75% | 1559 | s24 | SNP | 60% |
| 1524 | s21 | SNP | 75% | 1560 | s24 | REF | 65% |
| 1525 | s21 | SNP | 65% | 1561 | s24 | REF | 60% |
| 1526 | s21 | SNP | 70% | 1562 | s24 | SNP | 55% |
| 1527 | s23 | REF | 50% | 1563 | s24 | SNP | 50% |
| 1528 | s23 | SNP | 55% | 1564 | s24 | REF | 55% |
| 1529 | s23 | SNP | 50% | 1565 | s24 | SNP | 50% |
| 1530 | s23 | REF | 45% | 1566 | s24 | REF | 55% |
| 1531 | s23 | REF | 45% | 1567 | s24 | SNP | 50% |
| 1532 | s23 | SNP | 50% | 1568 | s24 | REF | 55% |
| 1533 | s23 | SNP | 60% | 1569 | s24 | SNP | 55% |
| 1534 | s23 | REF | 55% | 1570 | s24 | SNP | 45% |
| 1535 | s23 | REF | 50% | 1571 | s24 | REF | 50% |
| 1536 | s23 | SNP | 55% | 1572 | s24 | REF | 60% |
| 1537 | s23 | REF | 55% | 1573 | s24 | SNP | 50% |
| 1538 | s23 | SNP | 60% | 1574 | s24 | REF | 55% |
| 1539 | s23 | SNP | 55% | 1575 | s24 | REF | 55% |
| 1540 | s23 | SNP | 65% | 1576 | s24 | SNP | 50% |
| 1541 | s23 | REF | 60% | 1577 | s24 | REF | 50% |
| 1542 | s23 | REF | 50% | 1578 | s24 | SNP | 45% |
| 1543 | s23 | SNP | 55% | 1579 | s24 | REF | 65% |
| 1544 | s23 | SNP | 60% | 1580 | s24 | SNP | 60% |
| 1545 | s23 | REF | 55% | 1581 | s24 | REF | 55% |
| 1546 | s23 | SNP | 55% | 1582 | s24 | SNP | 50% |
| 1547 | s23 | REF | 50% | 1583 | s24 | REF | 55% |
| 1548 | s23 | REF | 60% | 1584 | s24 | SNP | 45% |
| 1549 | s23 | SNP | 65% | 1585 | s24 | REF | 50% |
| 1550 | s23 | SNP | 55% | 1586 | s24 | SNP | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1551 | s23 | REF | 50% | 1587 | s24 | SNP | 50% |
| 1552 | s23 | REF | 55% | 1588 | s24 | REF | 55% |
| 1553 | s23 | SNP | 60% | 1589 | s25 | SNP | 55% |
| 1554 | s23 | SNP | 60% | 1590 | s25 | REF | 60% |
| 1591 | s25 | SNP | 45% | 1627 | s26 | REF | 65% |
| 1592 | s25 | REF | 50% | 1628 | s27 | REF | 50% |
| 1593 | s25 | REF | 60% | 1629 | s27 | SNP | 45% |
| 1594 | s25 | SNP | 55% | 1630 | s27 | SNP | 45% |
| 1595 | s25 | SNP | 50% | 1631 | s27 | REF | 50% |
| 1596 | s25 | REF | 55% | 1632 | s27 | SNP | 50% |
| 1597 | s25 | REF | 65% | 1633 | s27 | SNP | 45% |
| 1598 | s25 | SNP | 60% | 1634 | s27 | SNP | 50% |
| 1599 | s25 | SNP | 55% | 1635 | s27 | REF | 55% |
| 1600 | s25 | REF | 60% | 1636 | s27 | SNP | 50% |
| 1601 | s25 | REF | 60% | 1637 | s27 | SNP | 50% |
| 1602 | s25 | SNP | 55% | 1638 | s27 | SNP | 45% |
| 1603 | s25 | REF | 60% | 1639 | s27 | REF | 50% |
| 1604 | s25 | SNP | 55% | 1640 | s27 | SNP | 45% |
| 1605 | s26 | SNP | 45% | 1641 | s27 | REF | 50% |
| 1606 | s26 | REF | 50% | 1642 | s27 | REF | 55% |
| 1607 | s26 | REF | 55% | 1643 | s27 | SNP | 50% |
| 1608 | s26 | SNP | 50% | 1644 | s27 | REF | 55% |
| 1609 | s26 | REF | 50% | 1645 | s27 | SNP | 50% |
| 1610 | s26 | SNP | 45% | 1646 | s27 | REF | 55% |
| 1611 | s26 | SNP | 45% | 1647 | s27 | SNP | 45% |
| 1612 | s26 | REF | 50% | 1648 | s27 | REF | 50% |
| 1613 | s26 | REF | 40% | 1649 | s27 | SNP | 45% |
| 1614 | s26 | SNP | 35% | 1650 | s27 | REF | 55% |
| 1615 | s26 | SNP | 60% | 1651 | s27 | SNP | 50% |
| 1616 | s26 | REF | 60% | 1652 | s27 | SNP | 45% |
| 1617 | s26 | SNP | 55% | 1653 | s27 | REF | 55% |
| 1618 | s26 | REF | 65% | 1654 | s27 | SNP | 50% |
| 1619 | s26 | SNP | 60% | 1655 | s27 | SNP | 50% |
| 1620 | s26 | REF | 50% | 1656 | s27 | REF | 55% |
| 1621 | s26 | SNP | 45% | 1657 | s27 | REF | 55% |
| 1622 | s26 | REF | 65% | 1658 | s27 | SNP | 50% |
| 1623 | s26 | SNP | 60% | 1659 | s28 | REF | 60% |
| 1624 | s26 | SNP | 65% | 1660 | s28 | SNP | 65% |
| 1625 | s26 | REF | 70% | 1661 | s28 | SNP | 65% |
| 1626 | s26 | SNP | 60% | 1662 | s28 | REF | 60% |
| 1663 | s28 | SNP | 65% | 1699 | s29 | REF | 55% |
| 1664 | s28 | REF | 60% | 1700 | s29 | SNP | 45% |
| 1665 | s28 | REF | 65% | 1701 | s29 | REF | 50% |
| 1666 | s28 | SNP | 70% | 1702 | s29 | SNP | 50% |
| 1667 | s28 | REF | 60% | 1703 | s29 | REF | 55% |
| 1668 | s28 | SNP | 65% | 1704 | s29 | REF | 45% |
| 1669 | s28 | REF | 55% | 1705 | s29 | SNP | 40% |
| 1670 | s28 | SNP | 60% | 1706 | s29 | REF | 55% |
| 1671 | s28 | SNP | 70% | 1707 | s29 | SNP | 50% |
| 1672 | s28 | REF | 65% | 1708 | s29 | SNP | 45% |
| 1673 | s28 | REF | 55% | 1709 | s29 | SNP | 50% |
| 1674 | s28 | SNP | 60% | 1710 | s29 | REF | 55% |
| 1675 | s28 | SNP | 55% | 1711 | s29 | REF | 50% |
| 1676 | s28 | REF | 50% | 1712 | s29 | SNP | 45% |
| 1677 | s28 | SNP | 65% | 1713 | s29 | SNP | 45% |
| 1678 | s28 | REF | 60% | 1714 | s29 | REF | 50% |
| 1679 | s28 | SNP | 60% | 1715 | s29 | REF | 50% |
| 1680 | s28 | REF | 65% | 1716 | s29 | REF | 50% |
| 1681 | s28 | SNP | 70% | 1717 | s29 | SNP | 45% |
| 1682 | s28 | SNP | 70% | 1718 | s29 | REF | 55% |
| 1683 | s28 | REF | 65% | 1719 | s29 | SNP | 50% |
| 1684 | s28 | REF | 60% | 1720 | s29 | REF | 55% |
| 1685 | s28 | SNP | 65% | 1721 | s29 | SNP | 50% |
| 1686 | s28 | REF | 55% | 1722 | s29 | SNP | 40% |
| 1687 | s28 | SNP | 55% | 1723 | s29 | REF | 45% |
| 1688 | s28 | SNP | 55% | 1724 | s29 | REF | 50% |
| 1689 | s28 | SNP | 60% | 1725 | s29 | SNP | 45% |
| 1690 | s28 | REF | 55% | 1726 | s29 | REF | 50% |
| 1691 | s83 | SNP | 45% | 1727 | s29 | SNP | 45% |
| 1692 | s83 | SNP | 50% | 1728 | s30 | REF | 60% |
| 1693 | s83 | SNP | 40% | 1729 | s30 | REF | 60% |
| 1694 | s83 | SNP | 45% | 1730 | s30 | SNP | 65% |
| 1695 | s83 | SNP | 45% | 1731 | s30 | SNP | 65% |
| 1696 | s83 | SNP | 50% | 1732 | s30 | SNP | 70% |
| 1697 | s83 | SNP | 50% | 1733 | s30 | REF | 65% |
| 1698 | s29 | SNP | 50% | 1734 | s30 | REF | 70% |
| 1735 | s30 | SNP | 75% | 1771 | s31 | REF | 40% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1736 | s30 | SNP | 65% | 1772 | s31 | SNP | 40% |
| 1737 | s30 | SNP | 60% | 1773 | s31 | REF | 40% |
| 1738 | s30 | SNP | 65% | 1774 | s31 | SNP | 40% |
| 1739 | s30 | SNP | 65% | 1775 | s31 | SNP | 60% |
| 1740 | s30 | SNP | 70% | 1776 | s31 | REF | 60% |
| 1741 | s30 | REF | 65% | 1777 | s31 | REF | 60% |
| 1742 | s30 | SNP | 65% | 1778 | s31 | REF | 50% |
| 1743 | s30 | SNP | 60% | 1779 | s31 | SNP | 50% |
| 1744 | s30 | SNP | 65% | 1780 | s31 | SNP | 60% |
| 1745 | s30 | REF | 60% | 1781 | s84 | SNP | 65% |
| 1746 | s30 | SNP | 65% | 1782 | s84 | REF | 65% |
| 1747 | s31 | REF | 35% | 1783 | s84 | REF | 75% |
| 1748 | s31 | SNP | 35% | 1784 | s84 | SNP | 65% |
| 1749 | s31 | REF | 50% | 1785 | s84 | REF | 70% |
| 1750 | s31 | SNP | 50% | 1786 | s84 | SNP | 60% |
| 1751 | s31 | SNP | 40% | 1787 | s84 | REF | 70% |
| 1752 | s31 | REF | 40% | 1788 | s84 | SNP | 70% |
| 1753 | s31 | REF | 70% | 1789 | s84 | SNP | 60% |
| 1754 | s31 | REF | 55% | 1790 | s32 | SNP | 50% |
| 1755 | s31 | SNP | 55% | 1791 | s32 | REF | 45% |
| 1756 | s31 | SNP | 40% | 1792 | s32 | REF | 50% |
| 1757 | s31 | REF | 40% | 1793 | s32 | SNP | 50% |
| 1758 | s31 | REF | 40% | 1794 | s32 | REF | 45% |
| 1759 | s31 | SNP | 40% | 1795 | s32 | REF | 55% |
| 1760 | s31 | SNP | 70% | 1796 | s32 | SNP | 60% |
| 1761 | s31 | SNP | 50% | 1797 | s32 | SNP | 70% |
| 1762 | s31 | REF | 50% | 1798 | s32 | SNP | 55% |
| 1763 | s31 | SNP | 55% | 1799 | s32 | REF | 50% |
| 1764 | s31 | REF | 55% | 1800 | s32 | SNP | 55% |
| 1765 | s31 | SNP | 50% | 1801 | s32 | REF | 50% |
| 1766 | s31 | REF | 50% | 1802 | s32 | REF | 65% |
| 1767 | s31 | SNP | 70% | 1803 | s32 | SNP | 70% |
| 1768 | s31 | REF | 70% | 1804 | s32 | SNP | 55% |
| 1769 | s31 | REF | 60% | 1805 | s32 | REF | 50% |
| 1770 | s31 | SNP | 60% | 1806 | s32 | REF | 65% |
| 1807 | s32 | REF | 65% | 1843 | s34 | REF | 70% |
| 1808 | s32 | SNP | 70% | 1844 | s34 | REF | 60% |
| 1809 | s32 | REF | 55% | 1845 | s34 | SNP | 55% |
| 1810 | s32 | SNP | 60% | 1846 | s34 | REF | 65% |
| 1811 | s32 | REF | 50% | 1847 | s34 | SNP | 60% |
| 1812 | s32 | SNP | 55% | 1848 | s34 | SNP | 60% |
| 1813 | s32 | SNP | 55% | 1849 | s34 | REF | 65% |
| 1814 | s32 | REF | 50% | 1850 | s34 | REF | 65% |
| 1815 | s32 | SNP | 55% | 1851 | s34 | SNP | 60% |
| 1816 | s32 | REF | 50% | 1852 | s34 | REF | 50% |
| 1817 | s32 | SNP | 55% | 1853 | s34 | REF | 65% |
| 1818 | s32 | SNP | 55% | 1854 | s34 | SNP | 60% |
| 1819 | s32 | REF | 50% | 1855 | s34 | REF | 65% |
| 1820 | s32 | SNP | 60% | 1856 | s34 | SNP | 60% |
| 1821 | s32 | REF | 55% | 1857 | s34 | REF | 70% |
| 1822 | s33 | REF | 65% | 1858 | s34 | SNP | 65% |
| 1823 | s33 | SNP | 60% | 1859 | s34 | REF | 60% |
| 1824 | s33 | REF | 65% | 1860 | s34 | SNP | 55% |
| 1825 | s33 | SNP | 60% | 1861 | s34 | REF | 65% |
| 1826 | s33 | REF | 65% | 1862 | s34 | SNP | 60% |
| 1827 | s33 | SNP | 60% | 1863 | s34 | SNP | 55% |
| 1828 | s33 | REF | 70% | 1864 | s34 | REF | 60% |
| 1829 | s33 | SNP | 65% | 1865 | s34 | SNP | 60% |
| 1830 | s33 | REF | 70% | 1866 | s34 | REF | 65% |
| 1831 | s33 | SNP | 65% | 1867 | s34 | SNP | 60% |
| 1832 | s33 | REF | 70% | 1868 | s34 | REF | 65% |
| 1833 | s33 | SNP | 65% | 1869 | s34 | SNP | 55% |
| 1834 | s33 | REF | 60% | 1870 | s34 | REF | 60% |
| 1835 | s33 | SNP | 65% | 1871 | s34 | SNP | 45% |
| 1836 | s33 | REF | 70% | 1872 | s34 | SNP | 45% |
| 1837 | s33 | SNP | 60% | 1873 | s34 | REF | 50% |
| 1838 | s33 | REF | 65% | 1874 | s35 | REF | 70% |
| 1839 | s33 | SNP | 55% | 1875 | s35 | REF | 65% |
| 1840 | s34 | SNP | 65% | 1876 | s36 | SNP | 40% |
| 1841 | s34 | SNP | 60% | 1877 | s36 | REF | 35% |
| 1842 | s34 | REF | 65% | 1878 | s36 | REF | 40% |
| 1879 | s36 | SNP | 45% | 1915 | s37 | SNP | 65% |
| 1880 | s36 | REF | 35% | 1916 | s37 | REF | 70% |
| 1881 | s36 | SNP | 40% | 1917 | s37 | SNP | 65% |
| 1882 | s36 | SNP | 40% | 1918 | s37 | SNP | 65% |
| 1883 | s36 | REF | 50% | 1919 | s37 | REF | 70% |
| 1884 | s36 | SNP | 55% | 1920 | s37 | SNP | 65% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 1885 | s36 | REF | 35% | 1921 | s37 | REF | 70% |
| 1886 | s36 | SNP | 40% | 1922 | s37 | SNP | 70% |
| 1887 | s36 | REF | 35% | 1923 | s37 | REF | 75% |
| 1888 | s36 | SNP | 40% | 1924 | s37 | SNP | 60% |
| 1889 | s36 | REF | 40% | 1925 | s37 | SNP | 60% |
| 1890 | s36 | SNP | 45% | 1926 | s37 | REF | 65% |
| 1891 | s36 | SNP | 55% | 1927 | s37 | REF | 65% |
| 1892 | s36 | REF | 50% | 1928 | s37 | REF | 65% |
| 1893 | s36 | SNP | 40% | 1929 | s37 | SNP | 60% |
| 1894 | s36 | REF | 35% | 1930 | s85 | SNP | 45% |
| 1895 | s36 | REF | 35% | 1931 | s38 | SNP | 45% |
| 1896 | s36 | REF | 40% | 1932 | s38 | REF | 50% |
| 1897 | s36 | SNP | 45% | 1933 | s38 | SNP | 50% |
| 1898 | s36 | SNP | 45% | 1934 | s38 | REF | 55% |
| 1899 | s36 | REF | 40% | 1935 | s38 | REF | 50% |
| 1900 | s36 | SNP | 45% | 1936 | s38 | REF | 55% |
| 1901 | s36 | REF | 40% | 1937 | s38 | SNP | 50% |
| 1902 | s36 | REF | 50% | 1938 | s38 | SNP | 45% |
| 1903 | s36 | SNP | 55% | 1939 | s38 | REF | 50% |
| 1904 | s36 | SNP | 55% | 1940 | s38 | SNP | 45% |
| 1905 | s36 | REF | 50% | 1941 | s38 | REF | 50% |
| 1906 | s36 | SNP | 45% | 1942 | s38 | SNP | 45% |
| 1907 | s36 | REF | 40% | 1943 | s38 | REF | 55% |
| 1908 | s37 | SNP | 50% | 1944 | s38 | SNP | 50% |
| 1909 | s37 | REF | 55% | 1945 | s38 | SNP | 50% |
| 1910 | s37 | SNP | 55% | 1946 | s38 | REF | 55% |
| 1911 | s37 | REF | 60% | 1947 | s38 | SNP | 50% |
| 1912 | s37 | REF | 60% | 1948 | s38 | REF | 55% |
| 1913 | s37 | SNP | 55% | 1949 | s38 | REF | 55% |
| 1914 | s37 | REF | 70% | 1950 | s38 | SNP | 50% |
| 1951 | s38 | REF | 50% | 1987 | s40 | REF | 45% |
| 1952 | s38 | SNP | 45% | 1988 | s40 | SNP | 40% |
| 1953 | s38 | SNP | 50% | 1989 | s40 | REF | 45% |
| 1954 | s38 | REF | 55% | 1990 | s40 | SNP | 40% |
| 1955 | s38 | SNP | 50% | 1991 | s40 | REF | 40% |
| 1956 | s38 | REF | 55% | 1992 | s40 | SNP | 35% |
| 1957 | s38 | REF | 55% | 1993 | s40 | SNP | 35% |
| 1958 | s38 | SNP | 50% | 1994 | s40 | REF | 40% |
| 1959 | s38 | REF | 55% | 1995 | s40 | REF | 50% |
| 1960 | s38 | SNP | 50% | 1996 | s40 | SNP | 45% |
| 1961 | s39 | REF | 40% | 1997 | s40 | REF | 50% |
| 1962 | s39 | SNP | 45% | 1998 | s40 | SNP | 45% |
| 1963 | s39 | REF | 40% | 1999 | s40 | SNP | 30% |
| 1964 | s39 | SNP | 45% | 2000 | s40 | REF | 35% |
| 1965 | s39 | REF | 40% | 2001 | s40 | REF | 50% |
| 1966 | s39 | SNP | 45% | 2002 | s40 | REF | 35% |
| 1967 | s39 | SNP | 30% | 2003 | s40 | SNP | 30% |
| 1968 | s39 | SNP | 30% | 2004 | s40 | REF | 45% |
| 1969 | s39 | SNP | 30% | 2005 | s40 | REF | 40% |
| 1970 | s39 | SNP | 45% | 2006 | s40 | SNP | 35% |
| 1971 | s39 | REF | 40% | 2007 | s40 | SNP | 40% |
| 1972 | s39 | REF | 40% | 2008 | s40 | REF | 45% |
| 1973 | s39 | SNP | 45% | 2009 | s40 | REF | 45% |
| 1974 | s39 | REF | 30% | 2010 | s40 | SNP | 40% |
| 1975 | s39 | SNP | 35% | 2011 | s40 | SNP | 40% |
| 1976 | s39 | SNP | 30% | 2012 | s41 | REF | 65% |
| 1977 | s39 | REF | 30% | 2013 | s41 | SNP | 65% |
| 1978 | s39 | SNP | 35% | 2014 | s41 | SNP | 65% |
| 1979 | s39 | SNP | 35% | 2015 | s41 | REF | 65% |
| 1980 | s39 | REF | 30% | 2016 | s41 | SNP | 70% |
| 1981 | s39 | SNP | 30% | 2017 | s41 | REF | 65% |
| 1982 | s40 | SNP | 45% | 2018 | s41 | REF | 70% |
| 1983 | s40 | SNP | 35% | 2019 | s41 | REF | 70% |
| 1984 | s40 | REF | 40% | 2020 | s41 | REF | 65% |
| 1985 | s40 | SNP | 45% | 2021 | s41 | REF | 65% |
| 1986 | s40 | REF | 50% | 2022 | s41 | REF | 70% |
| 2023 | s41 | SNP | 70% | 2059 | s42 | SNP | 50% |
| 2024 | s41 | REF | 60% | 2060 | s42 | REF | 70% |
| 2025 | s41 | REF | 65% | 2061 | s42 | SNP | 65% |
| 2026 | s41 | SNP | 65% | 2062 | s42 | REF | 65% |
| 2027 | s41 | REF | 65% | 2063 | s42 | SNP | 60% |
| 2028 | s41 | SNP | 60% | 2064 | s42 | REF | 45% |
| 2029 | s41 | REF | 65% | 2065 | s42 | REF | 50% |
| 2030 | s41 | SNP | 65% | 2066 | s42 | SNP | 45% |
| 2031 | s41 | REF | 60% | 2067 | s42 | SNP | 65% |
| 2032 | s41 | REF | 65% | 2068 | s42 | REF | 70% |
| 2033 | s41 | REF | 60% | 2069 | s42 | SNP | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2034 | s41 | REF | 65% | 2070 | s42 | REF | 55% |
| 2035 | s41 | REF | 65% | 2071 | s42 | SNP | 50% |
| 2036 | s41 | REF | 65% | 2072 | s42 | REF | 55% |
| 2037 | s41 | SNP | 65% | 2073 | s42 | SNP | 45% |
| 2038 | s41 | SNP | 65% | 2074 | s42 | REF | 50% |
| 2039 | s41 | REF | 65% | 2075 | s42 | REF | 60% |
| 2040 | s41 | REF | 65% | 2076 | s42 | SNP | 55% |
| 2041 | s41 | SNP | 65% | 2077 | s42 | REF | 50% |
| 2042 | s41 | REF | 70% | 2078 | s42 | REF | 45% |
| 2043 | s41 | REF | 60% | 2079 | s42 | SNP | 40% |
| 2044 | s41 | REF | 65% | 2080 | s42 | SNP | 45% |
| 2045 | s41 | SNP | 65% | 2081 | s42 | SNP | 60% |
| 2046 | s41 | REF | 65% | 2082 | s42 | REF | 65% |
| 2047 | s41 | SNP | 60% | 2083 | s42 | SNP | 40% |
| 2048 | s41 | REF | 60% | 2084 | s42 | REF | 45% |
| 2049 | s41 | SNP | 60% | 2085 | s42 | SNP | 40% |
| 2050 | s41 | REF | 60% | 2086 | s42 | REF | 45% |
| 2051 | s41 | REF | 60% | 2087 | s42 | SNP | 40% |
| 2052 | s41 | SNP | 60% | 2088 | s43 | SNP | 65% |
| 2053 | s41 | REF | 60% | 2089 | s43 | REF | 70% |
| 2054 | s42 | REF | 70% | 2090 | s43 | REF | 50% |
| 2055 | s42 | SNP | 65% | 2091 | s43 | SNP | 45% |
| 2056 | s42 | SNP | 45% | 2092 | s43 | REF | 60% |
| 2057 | s42 | REF | 50% | 2093 | s43 | SNP | 55% |
| 2058 | s42 | REF | 55% | 2094 | s43 | REF | 55% |
| 2095 | s43 | REF | 70% | 2131 | s46 | SNP | 50% |
| 2096 | s43 | SNP | 65% | 2132 | s46 | REF | 45% |
| 2097 | s43 | REF | 75% | 2133 | s46 | SNP | 45% |
| 2098 | s43 | SNP | 70% | 2134 | s46 | SNP | 40% |
| 2099 | s43 | SNP | 70% | 2135 | s46 | REF | 40% |
| 2100 | s43 | REF | 70% | 2136 | s47 | SNP | 65% |
| 2101 | s43 | SNP | 65% | 2137 | s47 | SNP | 70% |
| 2102 | s43 | SNP | 50% | 2138 | s47 | SNP | 60% |
| 2103 | s43 | REF | 75% | 2139 | s47 | SNP | 70% |
| 2104 | s43 | SNP | 70% | 2140 | s47 | SNP | 65% |
| 2105 | s43 | SNP | 70% | 2141 | s47 | SNP | 65% |
| 2106 | s43 | REF | 75% | 2142 | s47 | SNP | 65% |
| 2107 | s43 | REF | 75% | 2143 | s47 | SNP | 65% |
| 2108 | s43 | SNP | 70% | 2144 | s47 | SNP | 60% |
| 2109 | s43 | REF | 65% | 2145 | s47 | SNP | 70% |
| 2110 | s43 | SNP | 60% | 2146 | s47 | SNP | 70% |
| 2111 | s46 | SNP | 45% | 2147 | s47 | SNP | 75% |
| 2112 | s46 | REF | 45% | 2148 | s47 | SNP | 75% |
| 2113 | s46 | REF | 40% | 2149 | s47 | SNP | 70% |
| 2114 | s46 | SNP | 40% | 2150 | s47 | REF | 60% |
| 2115 | s46 | REF | 50% | 2151 | s47 | SNP | 65% |
| 2116 | s46 | SNP | 50% | 2152 | s48 | SNP | 60% |
| 2117 | s46 | REF | 35% | 2153 | s48 | SNP | 60% |
| 2118 | s46 | SNP | 35% | 2154 | s48 | SNP | 60% |
| 2119 | s46 | REF | 45% | 2155 | s48 | SNP | 65% |
| 2120 | s46 | SN | 45% | 2156 | s48 | SNP | 70% |
| 2121 | s46 | SNP | 50% | 2157 | s48 | REF | 65% |
| 2122 | s46 | SNP | 45% | 2158 | s48 | SNP | 65% |
| 2123 | s46 | SNP | 50% | 2159 | s48 | SNP | 65% |
| 2124 | s46 | REF | 50% | 2160 | s48 | SNP | 65% |
| 2125 | s46 | SNP | 50% | 2161 | s48 | SNP | 65% |
| 2126 | s46 | SNP | 45% | 2162 | s48 | SNP | 65% |
| 2127 | s46 | REF | 45% | 2163 | s48 | SNP | 70% |
| 2128 | s46 | SNP | 50% | 2164 | s48 | SNP | 65% |
| 2129 | s46 | REF | 50% | 2165 | s48 | SNP | 70% |
| 2130 | s46 | REF | 50% | 2166 | s48 | SNP | 70% |
| 2167 | s48 | SNP | 60% | 2203 | s52 | REF | 55% |
| 2168 | s48 | SNP | 65% | 2204 | s52 | SNP | 55% |
| 2169 | s48 | SNP | 60% | 2205 | s52 | REF | 60% |
| 2170 | s49 | SNP | 45% | 2206 | s52 | SNP | 65% |
| 2171 | s49 | SNP | 55% | 2207 | s52 | REF | 70% |
| 2172 | s49 | SNP | 45% | 2208 | s52 | SNP | 75% |
| 2173 | s50 | REF | 60% | 2209 | s52 | REF | 80% |
| 2174 | s50 | SNP | 55% | 2210 | s52 | SNP | 55% |
| 2175 | s50 | REF | 60% | 2211 | s52 | REF | 60% |
| 2176 | s50 | SNP | 55% | 2212 | s52 | REF | 70% |
| 2177 | s50 | SNP | 55% | 2213 | s52 | SNP | 65% |
| 2178 | s50 | REF | 60% | 2214 | s52 | REF | 55% |
| 2179 | s50 | REF | 60% | 2215 | s52 | SNP | 50% |
| 2180 | s50 | SNP | 55% | 2216 | s52 | SNP | 70% |
| 2181 | s50 | REF | 60% | 2217 | s52 | REF | 75% |
| 2182 | s50 | SNP | 55% | 2218 | s52 | SNP | 65% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2183 | s51 | REF | 65% | 2219 | s52 | REF | 50% |
| 2184 | s51 | REF | 50% | 2220 | s52 | SNP | 45% |
| 2185 | s52 | REF | 60% | 2221 | s52 | SNP | 65% |
| 2186 | s52 | SNP | 55% | 2222 | s52 | REF | 70% |
| 2187 | s52 | REF | 80% | 2223 | s53 | REF | 35% |
| 2188 | s52 | SNP | 75% | 2224 | s53 | SNP | 35% |
| 2189 | s52 | SNP | 45% | 2225 | s53 | REF | 35% |
| 2190 | s52 | REF | 75% | 2226 | s53 | SNP | 35% |
| 2191 | s52 | SNP | 70% | 2227 | s53 | SNP | 30% |
| 2192 | s52 | REF | 70% | 2228 | s53 | REF | 30% |
| 2193 | s52 | REF | 50% | 2229 | s53 | REF | 40% |
| 2194 | s52 | SNP | 45% | 2230 | s53 | SNP | 40% |
| 2195 | s52 | REF | 50% | 2231 | s53 | SNP | 35% |
| 2196 | s52 | REF | 60% | 2232 | s53 | REF | 35% |
| 2197 | s52 | SNP | 55% | 2233 | s53 | SNP | 55% |
| 2198 | s52 | SNP | 55% | 2234 | s53 | REF | 55% |
| 2199 | s52 | REF | 60% | 2235 | s53 | SNP | 45% |
| 2200 | s52 | REF | 60% | 2236 | s53 | REF | 45% |
| 2201 | s52 | SNP | 55% | 2237 | s53 | SNP | 35% |
| 2202 | s52 | SNP | 50% | 2238 | s53 | REF | 35% |
| 2239 | s53 | REF | 50% | 2275 | s54 | SNP | 45% |
| 2240 | s53 | SNP | 50% | 2276 | s54 | SNP | 60% |
| 2241 | s53 | REF | 45% | 2277 | s54 | REF | 55% |
| 2242 | s53 | SNP | 45% | 2278 | s54 | REF | 40% |
| 2243 | s53 | SNP | 30% | 2279 | s54 | SNP | 55% |
| 2244 | s53 | REF | 30% | 2280 | s54 | REF | 50% |
| 2245 | s53 | REF | 55% | 2281 | s54 | REF | 40% |
| 2246 | s53 | SNP | 40% | 2282 | s54 | SNP | 45% |
| 2247 | s53 | REF | 40% | 2283 | s55 | REF | 45% |
| 2248 | s53 | SNP | 50% | 2284 | s55 | SNP | 40% |
| 2249 | s53 | REF | 50% | 2285 | s55 | SNP | 40% |
| 2250 | s53 | SNP | 55% | 2286 | s55 | REF | 45% |
| 2251 | s53 | SNP | 35% | 2287 | s55 | REF | 50% |
| 2252 | s53 | REF | 35% | 2288 | s55 | SNP | 45% |
| 2253 | s54 | REF | 50% | 2289 | s55 | REF | 45% |
| 2254 | s54 | SNP | 55% | 2290 | s55 | SNP | 40% |
| 2255 | s54 | REF | 40% | 2291 | s55 | REF | 50% |
| 2256 | s54 | SNP | 45% | 2292 | s55 | REF | 45% |
| 2257 | s54 | REF | 55% | 2293 | s55 | SNP | 40% |
| 2258 | s54 | SNP | 45% | 2294 | s55 | REF | 55% |
| 2259 | s54 | REF | 40% | 2295 | s55 | SNP | 50% |
| 2260 | s54 | SNP | 60% | 2296 | s55 | SNP | 50% |
| 2261 | s54 | REF | 55% | 2297 | s55 | REF | 55% |
| 2262 | s54 | SNP | 60% | 2298 | s55 | REF | 50% |
| 2263 | s54 | REF | 55% | 2299 | s55 | SNP | 45% |
| 2264 | s54 | SNP | 60% | 2300 | s55 | REF | 55% |
| 2265 | s54 | SNP | 45% | 2301 | s55 | SNP | 50% |
| 2266 | s54 | SNP | 45% | 2302 | s55 | REF | 45% |
| 2267 | s54 | REF | 40% | 2303 | s55 | SNP | 40% |
| 2268 | s54 | SNP | 45% | 2304 | s55 | SNP | 45% |
| 2269 | s54 | REF | 40% | 2305 | s55 | REF | 50% |
| 2270 | s54 | REF | 50% | 2306 | s55 | REF | 50% |
| 2271 | s54 | SNP | 55% | 2307 | s55 | SNP | 45% |
| 2272 | s54 | SNP | 55% | 2308 | s55 | SNP | 45% |
| 2273 | s54 | REF | 50% | 2309 | s55 | REF | 50% |
| 2274 | s54 | REF | 40% | 2310 | s55 | SNP | 45% |
| 2311 | s55 | SNP | 40% | 2347 | s57 | SNP | 30% |
| 2312 | s55 | REF | 45% | 2348 | s57 | REF | 30% |
| 2313 | s55 | SNP | 45% | 2349 | s57 | SNP | 30% |
| 2314 | s55 | REF | 50% | 2350 | s57 | REF | 35% |
| 2315 | s56 | REF | 50% | 2351 | s57 | REF | 40% |
| 2316 | s56 | SNP | 45% | 2352 | s57 | SNP | 35% |
| 2317 | s56 | SNP | 30% | 2353 | s57 | REF | 30% |
| 2318 | s56 | SNP | 35% | 2354 | s57 | SNP | 45% |
| 2319 | s56 | REF | 40% | 2355 | s57 | SNP | 30% |
| 2320 | s56 | REF | 35% | 2356 | s57 | REF | 35% |
| 2321 | s56 | REF | 35% | 2357 | s57 | REF | 35% |
| 2322 | s56 | SNP | 30% | 2358 | s57 | SNP | 30% |
| 2323 | s56 | SNP | 50% | 2359 | s57 | SNP | 30% |
| 2324 | s56 | REF | 55% | 2360 | s57 | REF | 35% |
| 2325 | s56 | SNP | 30% | 2361 | s57 | REF | 50% |
| 2326 | s56 | SNP | 45% | 2362 | s57 | REF | 50% |
| 2327 | s56 | REF | 50% | 2363 | s57 | SNP | 45% |
| 2328 | s56 | REF | 55% | 2364 | s57 | REF | 30% |
| 2329 | s56 | REF | 35% | 2365 | s57 | REF | 35% |
| 2330 | s56 | SNP | 45% | 2366 | s57 | SNP | 30% |
| 2331 | s56 | REF | 50% | 2367 | s57 | SNP | 30% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2332 | s56 | SNP | 35% | 2368 | s57 | REF | 35% |
| 2333 | s56 | REF | 40% | 2369 | s57 | SNP | 35% |
| 2334 | s56 | REF | 35% | 2370 | s57 | REF | 40% |
| 2335 | s56 | SNP | 30% | 2371 | s58 | SNP | 40% |
| 2336 | s56 | SNP | 50% | 2372 | s58 | SNP | 40% |
| 2337 | s56 | REF | 55% | 2373 | s58 | REF | 45% |
| 2338 | s56 | REF | 45% | 2374 | s58 | SNP | 45% |
| 2339 | s56 | SNP | 40% | 2375 | s58 | REF | 45% |
| 2340 | s56 | SNP | 50% | 2376 | s58 | REF | 45% |
| 2341 | s56 | REF | 40% | 2377 | s58 | SNP | 40% |
| 2342 | s56 | SNP | 35% | 2378 | s58 | SNP | 45% |
| 2343 | s57 | REF | 30% | 2379 | s58 | SNP | 45% |
| 2344 | s57 | REF | 30% | 2380 | s58 | REF | 50% |
| 2345 | s57 | REF | 30% | 2381 | s58 | SNP | 45% |
| 2346 | s57 | REF | 35% | 2382 | s58 | REF | 50% |
| 2383 | s58 | REF | 55% | 2419 | s60 | SNP | 65% |
| 2384 | s58 | SNP | 50% | 2420 | s60 | REF | 70% |
| 2385 | s58 | REF | 55% | 2421 | s60 | SNP | 60% |
| 2386 | s58 | SNP | 50% | 2422 | s60 | REF | 65% |
| 2387 | s58 | SNP | 45% | 2423 | s60 | REF | 65% |
| 2388 | s58 | REF | 50% | 2424 | s60 | SNP | 60% |
| 2389 | s58 | SNP | 50% | 2425 | s60 | REF | 65% |
| 2390 | s58 | REF | 55% | 2426 | s60 | SNP | 60% |
| 2391 | s58 | REF | 50% | 2427 | s60 | REF | 60% |
| 2392 | s58 | SNP | 45% | 2428 | s60 | SNP | 55% |
| 2393 | s58 | REF | 45% | 2429 | s60 | REF | 65% |
| 2394 | s58 | SNP | 40% | 2430 | s60 | SNP | 60% |
| 2395 | s58 | SNP | 50% | 2431 | s60 | SNP | 60% |
| 2396 | s58 | REF | 55% | 2432 | s60 | REF | 65% |
| 2397 | s58 | REF | 50% | 2433 | s60 | REF | 70% |
| 2398 | s58 | SNP | 45% | 2434 | s60 | SNP | 65% |
| 2399 | s58 | REF | 50% | 2435 | s60 | SNP | 60% |
| 2400 | s58 | SNP | 45% | 2436 | s60 | REF | 65% |
| 2401 | s58 | SNP | 45% | 2437 | s60 | SNP | 60% |
| 2402 | s58 | SNP | 45% | 2438 | s60 | REF | 65% |
| 2403 | s59 | REF | 50% | 2439 | s60 | SNP | 60% |
| 2404 | s59 | SNP | 55% | 2440 | s60 | REF | 65% |
| 2405 | s59 | SNP | 55% | 2441 | s60 | REF | 65% |
| 2406 | s59 | SNP | 55% | 2442 | s60 | SNP | 60% |
| 2407 | s59 | REF | 50% | 2443 | s61 | SNP | 60% |
| 2408 | s59 | REF | 50% | 2444 | s61 | SNP | 70% |
| 2409 | s59 | SNP | 55% | 2445 | s61 | SNP | 60% |
| 2410 | s59 | SNP | 55% | 2446 | s61 | REF | 70% |
| 2411 | s59 | REF | 50% | 2447 | s61 | SNP | 70% |
| 2412 | s59 | SNP | 55% | 2448 | s61 | REF | 60% |
| 2413 | s60 | SNP | 60% | 2449 | s61 | REF | 65% |
| 2414 | s60 | REF | 65% | 2450 | s61 | SNP | 65% |
| 2415 | s60 | SNP | 60% | 2451 | s61 | REF | 75% |
| 2416 | s60 | REF | 65% | 2452 | s61 | SNP | 75% |
| 2417 | s60 | REF | 65% | 2453 | s61 | REF | 60% |
| 2418 | s60 | SNP | 60% | 2454 | s61 | REF | 70% |
| 2455 | s61 | SNP | 60% | 2491 | s62 | SNP | 45% |
| 2456 | s61 | SNP | 60% | 2492 | s62 | SNP | 45% |
| 2457 | s61 | SNP | 60% | 2493 | s62 | REF | 50% |
| 2458 | s61 | SNP | 70% | 2494 | s62 | SNP | 50% |
| 2459 | s61 | REF | 65% | 2495 | s62 | REF | 55% |
| 2460 | s61 | REF | 70% | 2496 | s62 | REF | 55% |
| 2461 | s61 | REF | 70% | 2497 | s62 | SNP | 45% |
| 2462 | s61 | SNP | 70% | 2498 | s62 | SNP | 50% |
| 2463 | s61 | REF | 60% | 2499 | s62 | REF | 50% |
| 2464 | s61 | REF | 65% | 2500 | s62 | SNP | 45% |
| 2465 | s61 | REF | 55% | 2501 | s63 | REF | 60% |
| 2466 | s61 | SNP | 55% | 2502 | s63 | SNP | 55% |
| 2467 | s61 | SNP | 65% | 2503 | s63 | REF | 55% |
| 2468 | s61 | SNP | 70% | 2504 | s63 | SNP | 50% |
| 2469 | s62 | SNP | 50% | 2505 | s63 | SNP | 50% |
| 2470 | s62 | REF | 50% | 2506 | s63 | REF | 55% |
| 2471 | s62 | REF | 45% | 2507 | s63 | REF | 50% |
| 2472 | s62 | SNP | 45% | 2508 | s63 | SNP | 45% |
| 2473 | s62 | REF | 50% | 2509 | s63 | REF | 55% |
| 2474 | s62 | REF | 50% | 2510 | s63 | SNP | 50% |
| 2475 | s62 | SNP | 45% | 2511 | s63 | REF | 60% |
| 2476 | s62 | SNP | 45% | 2512 | s63 | SNP | 55% |
| 2477 | s62 | REF | 55% | 2513 | s63 | REF | 55% |
| 2478 | s62 | REF | 45% | 2514 | s63 | REF | 60% |
| 2479 | s62 | REF | 55% | 2515 | s63 | SNP | 55% |
| 2480 | s62 | REF | 50% | 2516 | s63 | REF | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2481 | s62 | SNP | 50% | 2517 | s63 | SNP | 45% |
| 2482 | s62 | SNP | 50% | 2518 | s63 | SNP | 55% |
| 2483 | s62 | REF | 55% | 2519 | s63 | SNP | 55% |
| 2484 | s62 | REF | 50% | 2520 | s63 | REF | 60% |
| 2485 | s62 | REF | 55% | 2521 | s63 | REF | 60% |
| 2486 | s62 | SNP | 55% | 2522 | s63 | SNP | 55% |
| 2487 | s62 | REF | 55% | 2523 | s63 | REF | 60% |
| 2488 | s62 | SNP | 55% | 2524 | s63 | SNP | 50% |
| 2489 | s62 | SNP | 50% | 2525 | s63 | REF | 60% |
| 2490 | s62 | REF | 50% | 2526 | s63 | SNP | 55% |
| 2527 | s63 | SNP | 50% | 2563 | s65 | SNP | 50% |
| 2528 | s63 | REF | 55% | 2564 | s65 | SNP | 50% |
| 2529 | s64 | REF | 60% | 2565 | s65 | REF | 45% |
| 2530 | s64 | SNP | 55% | 2566 | s65 | SNP | 50% |
| 2531 | s64 | SNP | 45% | 2567 | s65 | REF | 45% |
| 2532 | s64 | REF | 50% | 2568 | s65 | REF | 45% |
| 2533 | s64 | REF | 55% | 2569 | s65 | SNP | 55% |
| 2534 | s64 | SNP | 50% | 2570 | s65 | REF | 50% |
| 2535 | s64 | SNP | 55% | 2571 | s65 | REF | 45% |
| 2536 | s64 | REF | 60% | 2572 | s65 | SNP | 50% |
| 2537 | s64 | REF | 50% | 2573 | s65 | SNP | 50% |
| 2538 | s64 | SNP | 45% | 2574 | s65 | REF | 45% |
| 2539 | s64 | SNP | 40% | 2575 | s86 | SNP | 35% |
| 2540 | s64 | REF | 45% | 2576 | s86 | SNP | 45% |
| 2541 | s65 | REF | 45% | 2577 | s86 | REF | 50% |
| 2542 | s65 | SNP | 50% | 2578 | s86 | SNP | 40% |
| 2543 | s65 | SNP | 50% | 2579 | s86 | REF | 45% |
| 2544 | s65 | REF | 45% | 2580 | s86 | SNP | 35% |
| 2545 | s65 | REF | 45% | 2581 | s86 | REF | 45% |
| 2546 | s65 | SNP | 50% | 2582 | s86 | SNP | 40% |
| 2547 | s65 | SNP | 50% | 2583 | s86 | REF | 45% |
| 2548 | s65 | REF | 45% | 2584 | s86 | SNP | 40% |
| 2549 | s65 | REF | 45% | 2585 | s86 | REF | 45% |
| 2550 | s65 | SNP | 50% | 2586 | s86 | SNP | 35% |
| 2551 | s65 | REF | 50% | 2587 | s86 | REF | 40% |
| 2552 | s65 | SNP | 55% | 2588 | s86 | REF | 45% |
| 2553 | s65 | SNP | 50% | 2589 | s86 | REF | 45% |
| 2554 | s65 | REF | 50% | 2590 | s86 | REF | 35% |
| 2555 | s65 | SNP | 55% | 2591 | s86 | REF | 45% |
| 2556 | s65 | REF | 55% | 2592 | s86 | REF | 30% |
| 2557 | s65 | SNP | 60% | 2593 | s86 | SNP | 40% |
| 2558 | s65 | SNP | 60% | 2594 | s86 | REF | 35% |
| 2559 | s65 | REF | 55% | 2595 | s86 | SNP | 40% |
| 2560 | s65 | SNP | 55% | 2596 | s86 | REF | 40% |
| 2561 | s65 | REF | 50% | 2597 | s86 | SNP | 35% |
| 2562 | s65 | REF | 45% | 2598 | s86 | REF | 40% |
| 2599 | s86 | SNP | 30% | 2635 | s67 | SNP | 45% |
| 2600 | s66 | SNP | 65% | 2636 | s67 | SNP | 35% |
| 2601 | s66 | REF | 70% | 2637 | s67 | REF | 30% |
| 2602 | s66 | REF | 75% | 2638 | s67 | REF | 45% |
| 2603 | s66 | SNP | 70% | 2639 | s67 | SNP | 50% |
| 2604 | s66 | SNP | 60% | 2640 | s67 | SNP | 40% |
| 2605 | s66 | REF | 65% | 2641 | s67 | REF | 35% |
| 2606 | s66 | SNP | 60% | 2642 | s67 | SNP | 35% |
| 2607 | s66 | REF | 65% | 2643 | s67 | SNP | 35% |
| 2608 | s66 | REF | 60% | 2644 | s67 | REF | 30% |
| 2609 | s66 | SNP | 55% | 2645 | s67 | SNP | 45% |
| 2610 | s66 | SNP | 60% | 2646 | s67 | REF | 40% |
| 2611 | s66 | REF | 65% | 2647 | s67 | SNP | 50% |
| 2612 | s66 | REF | 80% | 2648 | s67 | REF | 45% |
| 2613 | s66 | SNP | 75% | 2649 | s67 | REF | 40% |
| 2614 | s66 | REF | 70% | 2650 | s67 | SNP | 45% |
| 2615 | s66 | REF | 65% | 2651 | s67 | SNP | 45% |
| 2616 | s66 | SNP | 55% | 2652 | s67 | REF | 40% |
| 2617 | s66 | REF | 60% | 2653 | s67 | REF | 30% |
| 2618 | s66 | REF | 60% | 2654 | s67 | SNP | 35% |
| 2619 | s66 | SNP | 55% | 2655 | s67 | REF | 30% |
| 2620 | s66 | SNP | 70% | 2656 | s67 | SNP | 35% |
| 2621 | s66 | REF | 75% | 2657 | s67 | REF | 30% |
| 2622 | s66 | SNP | 55% | 2658 | s68 | SNP | 50% |
| 2623 | s66 | REF | 60% | 2659 | s68 | REF | 55% |
| 2624 | s67 | REF | 35% | 2660 | s68 | SNP | 45% |
| 2625 | s67 | SNP | 40% | 2661 | s68 | SNP | 45% |
| 2626 | s67 | SNP | 50% | 2662 | s68 | REF | 50% |
| 2627 | s67 | REF | 45% | 2663 | s68 | REF | 60% |
| 2628 | s67 | REF | 40% | 2664 | s68 | SNP | 55% |
| 2629 | s67 | SNP | 35% | 2665 | s68 | SNP | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2630 | s67 | REF | 30% | 2666 | s68 | REF | 55% |
| 2631 | s67 | SNP | 45% | 2667 | s68 | SNP | 55% |
| 2632 | s67 | REF | 30% | 2668 | s68 | REF | 60% |
| 2633 | s67 | SNP | 35% | 2669 | s68 | SNP | 45% |
| 2634 | s67 | REF | 40% | 2670 | s68 | SNP | 45% |
| 2671 | s68 | SNP | 50% | 2707 | s69 | REF | 80% |
| 2672 | s68 | REF | 55% | 2708 | s69 | SNP | 75% |
| 2673 | s68 | REF | 55% | 2709 | s69 | SNP | 70% |
| 2674 | s68 | SNP | 50% | 2710 | s69 | REF | 75% |
| 2675 | s68 | REF | 50% | 2711 | s69 | REF | 70% |
| 2676 | s68 | SNP | 55% | 2712 | s69 | SNP | 65% |
| 2677 | s68 | REF | 60% | 2713 | s69 | SNP | 65% |
| 2678 | s68 | SNP | 50% | 2714 | s70 | SNP | 45% |
| 2679 | s68 | SNP | 45% | 2715 | s70 | REF | 50% |
| 2680 | s68 | REF | 60% | 2716 | s70 | SNP | 45% |
| 2681 | s68 | SNP | 55% | 2717 | s70 | REF | 45% |
| 2682 | s68 | REF | 55% | 2718 | s70 | SNP | 40% |
| 2683 | s68 | SNP | 45% | 2719 | s70 | REF | 50% |
| 2684 | s68 | REF | 50% | 2720 | s70 | REF | 30% |
| 2685 | s68 | REF | 50% | 2721 | s70 | REF | 30% |
| 2686 | s68 | SNP | 45% | 2722 | s70 | REF | 50% |
| 2687 | s68 | REF | 50% | 2723 | s70 | SNP | 45% |
| 2688 | s68 | SNP | 45% | 2724 | s70 | REF | 30% |
| 2689 | s68 | REF | 50% | 2725 | s70 | REF | 40% |
| 2690 | s68 | SNP | 45% | 2726 | s70 | SNP | 35% |
| 2691 | s68 | SNP | 50% | 2727 | s70 | SNP | 30% |
| 2692 | s69 | SNP | 70% | 2728 | s70 | REF | 35% |
| 2693 | s69 | REF | 75% | 2729 | s70 | REF | 50% |
| 2694 | s69 | SNP | 70% | 2730 | s70 | SNP | 45% |
| 2695 | s69 | SNP | 70% | 2731 | s70 | SNP | 40% |
| 2696 | s69 | REF | 75% | 2732 | s70 | REF | 45% |
| 2697 | s69 | REF | 75% | 2733 | s70 | SNP | 35% |
| 2698 | s69 | SNP | 70% | 2734 | s70 | REF | 40% |
| 2699 | s69 | REF | 75% | 2735 | s70 | REF | 30% |
| 2700 | s69 | SNP | 70% | 2736 | s71 | REF | 75% |
| 2701 | s69 | REF | 75% | 2737 | s71 | SNP | 75% |
| 2702 | s69 | REF | 70% | 2738 | s71 | SNP | 75% |
| 2703 | s69 | SNP | 65% | 2739 | s71 | SNP | 75% |
| 2704 | s69 | REF | 70% | 2740 | s71 | REF | 75% |
| 2705 | s69 | REF | 75% | 2741 | s71 | REF | 75% |
| 2706 | s69 | SNP | 70% | 2742 | s71 | REF | 75% |
| 2743 | s71 | SNP | 75% | 2779 | s72 | SNP | 40% |
| 2744 | s71 | REF | 70% | 2780 | s72 | REF | 45% |
| 2745 | s71 | SNP | 70% | 2781 | s72 | REF | 45% |
| 2746 | s71 | REF | 75% | 2782 | s72 | SNP | 40% |
| 2747 | s71 | SNP | 75% | 2783 | s72 | REF | 45% |
| 2748 | s71 | SNP | 80% | 2784 | s72 | SNP | 40% |
| 2749 | s71 | REF | 80% | 2785 | s72 | REF | 50% |
| 2750 | s71 | SNP | 75% | 2786 | s72 | SNP | 40% |
| 2751 | s71 | REF | 75% | 2787 | s72 | REF | 45% |
| 2752 | s71 | SNP | 85% | 2788 | s72 | REF | 40% |
| 2753 | s71 | REF | 85% | 2789 | s72 | REF | 50% |
| 2754 | s71 | REF | 75% | 2790 | s72 | SNP | 45% |
| 2755 | s71 | SNP | 75% | 2791 | s72 | SNP | 45% |
| 2756 | s71 | SNP | 70% | 2792 | s72 | REF | 50% |
| 2757 | s71 | REF | 70% | 2793 | s72 | REF | 45% |
| 2758 | s71 | REF | 75% | 2794 | s72 | REF | 45% |
| 2759 | s71 | SNP | 75% | 2795 | s72 | REF | 45% |
| 2760 | s71 | REF | 70% | 2796 | s72 | REF | 45% |
| 2761 | s71 | SNP | 70% | 2797 | s72 | SNP | 40% |
| 2762 | s72 | SNP | 35% | 2798 | s72 | REF | 45% |
| 2763 | s72 | REF | 40% | 2799 | s72 | SNP | 40% |
| 2764 | s72 | SNP | 35% | 2800 | s73 | SNP | 55% |
| 2765 | s72 | REF | 45% | 2801 | s73 | SNP | 50% |
| 2766 | s72 | SNP | 40% | 2802 | s73 | REF | 55% |
| 2767 | s72 | SNP | 40% | 2803 | s73 | REF | 60% |
| 2768 | s72 | REF | 45% | 2804 | s73 | REF | 50% |
| 2769 | s72 | SNP | 45% | 2805 | s73 | SNP | 45% |
| 2770 | s72 | REF | 50% | 2806 | s73 | SNP | 50% |
| 2771 | s72 | SNP | 40% | 2807 | s73 | REF | 55% |
| 2772 | s72 | REF | 45% | 2808 | s73 | REF | 60% |
| 2773 | s72 | SNP | 45% | 2809 | s73 | SNP | 55% |
| 2774 | s72 | REF | 50% | 2810 | s73 | REF | 55% |
| 2775 | s72 | SNP | 40% | 2811 | s73 | SNP | 50% |
| 2776 | s72 | REF | 45% | 2812 | s73 | REF | 55% |
| 2777 | s72 | REF | 50% | 2813 | s73 | REF | 55% |
| 2778 | s72 | REF | 45% | 2814 | s73 | SNP | 50% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2815 | s73 | SNP | 55% | 2851 | s74 | REF | 40% |
| 2816 | s73 | REF | 60% | 2852 | s74 | REF | 40% |
| 2817 | s73 | SNP | 55% | 2853 | s74 | SNP | 35% |
| 2818 | s73 | REF | 60% | 2854 | s74 | REF | 45% |
| 2819 | s73 | SNP | 50% | 2855 | s74 | SNP | 40% |
| 2820 | s73 | REF | 55% | 2856 | s75 | SNP | 45% |
| 2821 | s73 | REF | 55% | 2857 | s75 | REF | 40% |
| 2822 | s73 | SNP | 50% | 2858 | s75 | REF | 35% |
| 2823 | s73 | REF | 60% | 2859 | s75 | SNP | 40% |
| 2824 | s73 | SNP | 55% | 2860 | s75 | REF | 45% |
| 2825 | s73 | REF | 55% | 2861 | s75 | SNP | 50% |
| 2826 | s73 | SNP | 50% | 2862 | s75 | SNP | 30% |
| 2827 | s73 | SNP | 45% | 2863 | s75 | SNP | 50% |
| 2828 | s73 | REF | 50% | 2864 | s75 | REF | 45% |
| 2829 | s73 | SNP | 50% | 2865 | s75 | REF | 45% |
| 2830 | s74 | SNP | 40% | 2866 | s75 | SNP | 50% |
| 2831 | s74 | REF | 45% | 2867 | s75 | SNP | 55% |
| 2832 | s74 | SNP | 35% | 2868 | s75 | REF | 50% |
| 2833 | s74 | REF | 40% | 2869 | s75 | REF | 40% |
| 2834 | s74 | REF | 50% | 2870 | s75 | SNP | 45% |
| 2835 | s74 | REF | 45% | 2871 | s75 | SNP | 35% |
| 2836 | s74 | REF | 55% | 2872 | s75 | REF | 30% |
| 2837 | s74 | SNP | 50% | 2873 | s75 | SNP | 45% |
| 2838 | s74 | SNP | 40% | 2874 | s75 | REF | 40% |
| 2839 | s74 | REF | 45% | 2875 | s75 | SNP | 50% |
| 2840 | s74 | SNP | 45% | 2876 | s75 | REF | 45% |
| 2841 | s74 | REF | 50% | 2877 | s75 | REF | 30% |
| 2842 | s74 | REF | 45% | 2878 | s75 | SNP | 35% |
| 2843 | s74 | SNP | 45% | 2879 | s75 | SNP | 30% |
| 2844 | s74 | REF | 50% | 2880 | s75 | REF | 50% |
| 2845 | s74 | SNP | 40% | 2881 | s75 | SNP | 55% |
| 2846 | s74 | SNP | 40% | 2882 | s75 | SNP | 55% |
| 2847 | s74 | REF | 45% | 2883 | s75 | REF | 50% |
| 2848 | s74 | REF | 40% | 2884 | s75 | REF | 50% |
| 2849 | s74 | SNP | 35% | 2885 | s75 | SNP | 55% |
| 2850 | s74 | SNP | 35% | 2886 | s75 | REF | 40% |
| 2887 | s75 | SNP | 45% | 2923 | s76 | REF | 55% |
| 2888 | s75 | SNP | 30% | 2924 | s76 | SNP | 50% |
| 2889 | s87 | SNP | 60% | 2925 | s76 | REF | 45% |
| 2890 | s87 | SNP | 65% | 2926 | s76 | REF | 50% |
| 2891 | s87 | SNP | 65% | 2927 | s76 | SNP | 45% |
| 2892 | s87 | SNP | 60% | 2928 | s76 | REF | 45% |
| 2893 | s87 | SNP | 65% | 2929 | s76 | SNP | 40% |
| 2894 | s87 | SNP | 65% | 2930 | s76 | SNP | 50% |
| 2895 | s87 | SNP | 70% | 2931 | s76 | REF | 55% |
| 2896 | s87 | SNP | 60% | 2932 | s76 | SNP | 40% |
| 2897 | s87 | REF | 55% | 2933 | s76 | REF | 45% |
| 2898 | s87 | SNP | 65% | 2934 | s76 | SNP | 40% |
| 2899 | s87 | REF | 45% | 2935 | s77 | SNP | 60% |
| 2900 | s87 | SNP | 50% | 2936 | s77 | REF | 65% |
| 2901 | s87 | SNP | 65% | 2937 | s77 | REF | 80% |
| 2902 | s87 | SNP | 65% | 2938 | s77 | SNP | 75% |
| 2903 | s87 | SNP | 65% | 2939 | s77 | SNP | 75% |
| 2904 | s87 | SNP | 50% | 2940 | s77 | SNP | 45% |
| 2905 | s76 | SNP | 45% | 2941 | s77 | REF | 50% |
| 2906 | s76 | SNP | 45% | 2942 | s77 | REF | 55% |
| 2907 | s76 | REF | 50% | 2943 | s77 | SNP | 50% |
| 2908 | s76 | SNP | 50% | 2944 | s77 | REF | 70% |
| 2909 | s76 | REF | 55% | 2945 | s77 | SNP | 65% |
| 2910 | s76 | SNP | 45% | 2946 | s77 | SNP | 75% |
| 2911 | s76 | REF | 50% | 2947 | s77 | REF | 50% |
| 2912 | s76 | SNP | 45% | 2948 | s77 | SNP | 45% |
| 2913 | s76 | REF | 50% | 2949 | s77 | REF | 40% |
| 2914 | s76 | SNP | 45% | 2950 | s77 | REF | 80% |
| 2915 | s76 | REF | 50% | 2951 | s77 | SNP | 75% |
| 2916 | s76 | REF | 50% | 2952 | s77 | REF | 80% |
| 2917 | s76 | SNP | 45% | 2953 | s77 | SNP | 35% |
| 2918 | s76 | REF | 50% | 2954 | s77 | REF | 65% |
| 2919 | s76 | SNP | 45% | 2955 | s77 | SNP | 60% |
| 2920 | s76 | REF | 50% | 2956 | s77 | SNP | 60% |
| 2921 | s76 | REF | 55% | 2957 | s77 | REF | 65% |
| 2922 | s76 | SNP | 50% | 2958 | s77 | REF | 80% |
| 2959 | s77 | SNP | 75% | 2985 | s78 | SNP | 40% |
| 2960 | s77 | REF | 80% | 2986 | s78 | REF | 45% |
| 2961 | s77 | SNP | 75% | 2987 | s78 | REF | 35% |
| 2962 | s77 | SNP | 50% | 2988 | s78 | SNP | 30% |
| 2963 | s77 | REF | 55% | 2989 | s78 | SNP | 40% |

TABLE 2-continued

| SEQ ID NO: | SNP ID (Table 1) | Target (SNP/REF) | % GC | SEQ ID NO: | SNP ID (Table 1) | Target (SNP/REF) | % GC |
|---|---|---|---|---|---|---|---|
| 2964 | s77 | REF | 55% | 2990 | s78 | REF | 45% |
| 2965 | s77 | SNP | 50% | 2991 | s78 | REF | 45% |
| 2966 | s77 | REF | 65% | 2992 | s78 | SNP | 40% |
| 2967 | s77 | SNP | 60% | 2993 | s78 | REF | 45% |
| 2968 | s77 | REF | 80% | 2994 | s78 | SNP | 45% |
| 2969 | s77 | SNP | 35% | 2995 | s78 | REF | 50% |
| 2970 | s77 | REF | 40% | 2996 | s78 | SNP | 40% |
| 2971 | s77 | SNP | 65% | 2997 | s78 | REF | 45% |
| 2972 | s77 | REF | 70% | 2998 | s78 | REF | 50% |
| 2973 | s77 | SNP | 50% | 2999 | s78 | SNP | 35% |
| 2974 | s77 | REF | 55% | 3000 | s78 | SNP | 45% |
| 2975 | s78 | REF | 40% | 3001 | s78 | REF | 40% |
| 2976 | s78 | SNP | 30% | 3002 | s78 | SNP | 40% |
| 2977 | s78 | SNP | 35% | 3003 | s78 | REF | 45% |
| 2978 | s78 | REF | 35% | 3004 | s78 | REF | 40% |
| 2979 | s78 | SNP | 40% | 3005 | s78 | SNP | 35% |
| 2980 | s78 | REF | 45% | 3006 | s78 | SNP | 30% |
| 2981 | s78 | REF | 45% | 3007 | s78 | SNP | 40% |
| 2982 | s78 | SNP | 40% | 3008 | s78 | REF | 35% |
| 2983 | s78 | SNP | 35% | 3009 | s78 | REF | 45% |
| 2984 | s78 | REF | 40% | 3010 | s78 | SNP | 40% |

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only.

EXPERIMENTAL DETAILS

Example 1: BEST1 Correction Analysis

Guide sequences comprising 17-20 nucleotides in the sequences of 17-20 contiguous nucleotides set forth in SEQ ID NOs: 1-3010 are screened for high on target activity. On target activity is determined by DNA capillary electrophoresis analysis.

According to DNA capillary electrophoresis analysis, guide sequences comprising 17-20 nucleotides in the sequences of 17-20 contiguous nucleotides set forth in SEQ ID NOs: 1-3010 are found to be suitable for correction of the BEST1 gene.

DISCUSSION

The guide sequences of the present invention are determined to be suitable for targeting the BEST1 gene.

REFERENCES

1. Ahmad and Allen (1992) "Antibody-mediated Specific Binging and Cytotoxicity of Lipsome-entrapped Doxorubicin to Lung Cancer Cells in Vitro", Cancer Research 52:4817-20
2. Anders (1992) "Human gene therapy", Science 256:808-13
3. Basha et al. (2011) "Influence of Cationic Lipid Composition on Gene Silencing Properties of Lipid Nanoparticle Formulations of siRNA in Antigen-Presenting Cells", Mol. Ther. 19(12):2186-200
4. Behr (1994) Gene transfer with synthetic cationic amphiphiles: Prospects for gene therapy", Bioconjuage Chem 5:382-89
5. Blaese (1995) "Vectors in cancer therapy: how will they deliver", Cancer Gene Ther. 2:291-97
6. Blaese et al. (1995) "T lympocyte-directed gene therapy for ADA-SCID: initial trial results after 4 years", Science 270(5235):475-80
7. Buchschacher and Panganiban (1992) "Human immunodeficiency virus vectors for inducible expression of foreign genes", J. Virol. 66:2731-39
8. Burstein et al. (2017) "New CRISPR-Cas systems from uncultivated microbes", Nature 542:237-41
9. Chung et al. (2006) "*Agrobacterium* is not alone: gene transfer to plants by viruses and other bacteria", Trends Plant Sci. 11(1):1-4
10. Coelho et al. (2013) "Safety and Efficacy of RNAi Therapy for Transthyretin Amyloidosis", N Engl J. Med 369:819-29
11. Crystal (1995) "Transfer of genes to humans: early lessons and obstacles to success", Science 270(5235): 404-10
12. Dillon (1993) "Regulation gene expression in gene therapy" Trends in Biotechnology 11(5):167-173
13. Dranoff et al. (1997) "A phase I study of vaccination with autologous, irradiated melanoma cells engineered to secrete human granulocyte macrophage colony stimulating factor", Hum. Gene Ther. 8(1):111-23
14. Dunbar et al. (1995) "Retrovirally marked CD34-enriched peripheral blood and bone marrow cells contribute to long-term engraftment after autologous transplantation", Blood 85:3048-57
15. Ellem et al. (1997) "A case report: immune responses and clinical course of the first human use of ganulocyte/macrophage-colony-stimulating-factor-tranduced autologous melanoma cells for immunotherapy", Cancer Immunol Immunother 44:10-20
16. Gao and Huang (1995) "Cationic liposome-mediated gene transfer" Gene Ther. 2(10):710-22
17. Haddada et al. (1995) "Gene Therapy Using Adenovirus Vectors", in: The Molecular Repertoire of Adenoviruses III: Biology and Pathogenesis, ed. Doerfler and Bohm, pp. 297-306

18. Han et al. (1995) "Ligand-directed retro-viral targeting of human breast cancer cells", Proc Natl Acad Sci U.S.A. 92(21):9747-51
19. Inaba et al. (1992) "Generation of large numbers of dendritic cells from mouse bone marrow cultures supplemented with granulocyte/macrophage colony-stimulating factor", J Exp Med. 176(6):1693-702
20. Jinek et al. (2012) "A programmable dual-RNA-guided DNA endonuclease in adaptive bacterial immunity," Science 337(6096):816-21
21. Johan et al. (1992) "GLVR1, a receptor for gibbon ape leukemia virus, is homologous to a phosphate permease of *Neurospora crassa* and is expressed at high levels in the brain and thymus", J Virol 66(3):1635-40
22. Judge et al. (2006) "Design of noninflammatory synthetic siRNA mediating potent gene silencing in vivo", Mol Ther. 13(3):494-505
23. Kohn et al. (1995) "Engraftment of gene-modified umbilical cord blood cells in neonates with adnosine deaminase deficiency", Nature Medicine 1:1017-23
24. Kremer and Perricaudet (1995) "Adenovirus and adeno-associated virus mediated gene transfer", Br. Med. Bull. 51(1):31-44
25. Macdiarmid et al. (2009) "Sequential treatment of drug-resistant tumors with targeted minicells containing siRNA or a cytotoxic drug", Nat Biotehcnol. 27(7):643-51
26. Malech et al. (1997) "Prolonged production of NADPH oxidase-corrected granulocyes after gene therapy of chronic granulomatous disease", PNAS 94(22):12133-38
27. Miller et al. (1991) "Construction and properties of retrovirus packaging cells based on gibbon ape leukemia virus", J Virol. 65(5):2220-24
28. Miller (1992) "Human gene therapy comes of age", Nature 357:455-60
29. Mitani and Caskey (1993) "Delivering therapeutic genes—matching approach and application", Trends in Biotechnology 11(5):162-66
30. Nabel and Felgner (1993) "Direct gene transfer for immunotherapy and immunization", Trends in Biotechnology 11(5):211-15
31. Remy et al. (1994) "Gene Transfer with a Series of Lipphilic DNA-Binding Molecules", Bioconjugate Chem. 5(6):647-54
32. Sentmanat et al. (2018) "A Survey of Validation Strategies for CRISPR-Cas9 Editing", Scientific Reports 8:888, doi:10.1038/s41598-018-19441-8
33. Sommerfelt et al. (1990) "Localization of the receptor gene for type D simian retroviruses on human chromosome 19", J. Virol. 64(12):6214-20
34. Van Brunt (1988) "Molecular framing: transgenic animals as bioactors" Biotechnology 6:1149-54
35. Vigne et al. (1995) "Third-generation adenovectors for gene therapy", Restorative Neurology and Neuroscience 8(1,2): 35-36
36. Wilson et al. (1989) "Formation of infectious hybrid virion with gibbon ape leukemia virus and human T-cell leukemia virus retroviral envelope glycoproteins and the gag and pol proteins of Moloney murine leukemia virus", J. Virol. 63:2374-78
37. Yu et al. (1994) "Progress towards gene therapy for HIV infection", Gene Ther. 1(1):13-26
38. Zetsche et al. (2015) "Cpf1 is a single RNA-guided endonuclease of a class 2 CRIPSR-Cas system" Cell 163(3):759-71
39. Zuris et al. (2015) "Cationic lipid-mediated delivery of proteins enables efficient protein based genome editing in vitro and in vivo" Nat Biotechnol. 33(1):73-80

SEQUENCE LISTING (3014 sequences)

SEQ ID NO: 1 - RNA, 20 nt, Artificial Sequence
  synthesized
auccgucagguuaaacucca

SEQ ID NO: 2 - RNA, 20 nt, Artificial Sequence
  synthesized
ucucaagugaggaggaaaac

SEQ ID NO: 3 - RNA, 20 nt, Artificial Sequence
  synthesized
gccuccugaggagcugggug

SEQ ID NO: 4 - RNA, 20 nt, Artificial Sequence
  synthesized
agaggagcugaaaccuaccc

SEQ ID NO: 5 - RNA, 20 nt, Artificial Sequence
  synthesized
aggagcugaaaccuacccgg

SEQ ID NO: 6 - RNA, 20 nt, Artificial Sequence
  synthesized
agcagauuacaagaagggac

SEQ ID NO: 7 - RNA, 20 nt, Artificial Sequence
  synthesized
ccacaaaggaguccuugucu

SEQ ID NO: 8 - RNA, 20 nt, Artificial Sequence
  synthesized
cuccacaaaggaguccuugu

SEQ ID NO: 9 - RNA, 20 nt, Artificial Sequence
  synthesized
aguagcagagcaggaagauu

SEQ ID NO: 10 - RNA, 20 nt, Artificial Sequence
  synthesized
cugcagaguggagugaagaa

SEQ ID NO: 11 - RNA, 20 nt, Artificial Sequence
  synthesized
gcagaguggagugaagaagg

SEQ ID NO: 12 - RNA, 20 nt, Artificial Sequence
  synthesized
cugagggucuuccgagagcc

SEQ ID NO: 13 - RNA, 20 nt, Artificial Sequence
  synthesized
aacaugggaguggggcugag

SEQ ID NO: 14 - RNA, 20 nt, Artificial Sequence
  synthesized
agcaccccuguccagcuaug

SEQ ID NO: 15 - RNA, 20 nt, Artificial Sequence
  synthesized
caccccuguccagcuaugcc

SEQ ID NO: 16 - RNA, 20 nt, Artificial Sequence
  synthesized
agccugccggggcuggugga

SEQ ID NO: 17 - RNA, 20 nt, Artificial Sequence
  synthesized
guuuugaauugcucucagag

SEQ ID NO: 18 - RNA, 20 nt, Artificial Sequence
  synthesized
uuugaauugcucucagagag

SEQ ID NO: 19 - RNA, 20 nt, Artificial Sequence
  synthesized
gcugcuauuuccacacccca

SEQ ID NO: 20 - RNA, 20 nt, Artificial Sequence
  synthesized
ugaacuccugaccucaagua

SEQ ID NO: 21 - RNA, 20 nt, Artificial Sequence
  synthesized
uauuaaagagagguuggccg

SEQ ID NO: 22 - RNA, 20 nt, Artificial Sequence
  synthesized
gggugaagugagaaaagguc

SEQ ID NO: 23 - RNA, 20 nt, Artificial Sequence
  synthesized
gugaagugagaaaagguccc

SEQ ID NO: 24 - RNA, 20 nt, Artificial Sequence
  synthesized
agaccagggcuggaauuuag

SEQ ID NO: 25 - RNA, 20 nt, Artificial Sequence
  synthesized
ugagaccagggcuggaauuu

SEQ ID NO: 26 - RNA, 20 nt, Artificial Sequence
  synthesized
gaaggaaauggggaugagcu

SEQ ID NO: 27 - RNA, 20 nt, Artificial Sequence
  synthesized
cuuuuaaacaacugacccuu

SEQ ID NO: 28 - RNA, 20 nt, Artificial Sequence
  synthesized
aaggugcggacugcagccag

SEQ ID NO: 29 - RNA, 20 nt, Artificial Sequence
  synthesized
gaaaggugcggacugcagcc

SEQ ID NO: 30 - RNA, 20 nt, Artificial Sequence
  synthesized
auuggacccccaaaucuuga

SEQ ID NO: 31 - RNA, 20 nt, Artificial Sequence
  synthesized
caauuggacccccaaaucuu

SEQ ID NO: 32 - RNA, 20 nt, Artificial Sequence
  synthesized
ggaggaggaugugguagcaa

SEQ ID NO: 33 - RNA, 20 nt, Artificial Sequence
  synthesized
ggaugugguagcaaagggcu

SEQ ID NO: 34 - RNA, 20 nt, Artificial Sequence
  synthesized
gacucuuuuucagcaugcau

SEQ ID NO: 35 - RNA, 20 nt, Artificial Sequence
  synthesized
gcccuuugcuuuggcaggga

SEQ ID NO: 36 - RNA, 20 nt, Artificial Sequence
  synthesized
gaacugaacaacggcacuua

SEQ ID NO: 37 - RNA, 20 nt, Artificial Sequence
  synthesized
acuccguccuucagggauca

SEQ ID NO: 38 - RNA, 20 nt, Artificial Sequence
  synthesized
ccacccugagcucaggcagc

SEQ ID NO: 39 - RNA, 20 nt, Artificial Sequence
  synthesized
uacuccguccuucagggauc

SEQ ID NO: 40 - RNA, 20 nt, Artificial Sequence
  synthesized
aguugcuucagagagaugga

SEQ ID NO: 41 - RNA, 20 nt, Artificial Sequence
  synthesized
aaaggcaaaaauggugugug

SEQ ID NO: 42 - RNA, 20 nt, Artificial Sequence
  synthesized
aggcaaaaaugguguguggg

SEQ ID NO: 43 - RNA, 20 nt, Artificial Sequence
  synthesized
aauaauacaaugacaaaggc

SEQ ID NO: 44 - RNA, 20 nt, Artificial Sequence
  synthesized
ugugugucacagugacagga

SEQ ID NO: 45 - RNA, 20 nt, Artificial Sequence
  synthesized
ugugugugugucacagugac

SEQ ID NO: 46 - RNA, 20 nt, Artificial Sequence
  synthesized
ugugugugugugugucacag

SEQ ID NO: 47 - RNA, 20 nt, Artificial Sequence
  synthesized
ugugugugugugugugucac

SEQ ID NO: 48 - RNA, 20 nt, Artificial Sequence
  synthesized
cuggauguagcugucgcaau

SEQ ID NO: 49 - RNA, 20 nt, Artificial Sequence
  synthesized
ggauguagcugucgcaauac

SEQ ID NO: 50 - RNA, 20 nt, Artificial Sequence
  synthesized
gaccaaggaagcagcugggg

SEQ ID NO: 51 - RNA, 20 nt, Artificial Sequence
  synthesized
aggaccaaggaagcagcugg

SEQ ID NO: 52 - RNA, 20 nt, Artificial Sequence
  synthesized
aagcagcuggggugggaagg

SEQ ID NO: 53 - RNA, 20 nt, Artificial Sequence
  synthesized
ccaaggaagcagcuggggug

SEQ ID NO: 54 - RNA, 20 nt, Artificial Sequence
  synthesized
ggaagcagcuggggugggaa

SEQ ID NO: 55 - RNA, 20 nt, Artificial Sequence
  synthesized
ggggugggaagggcucaccu

SEQ ID NO: 56 - RNA, 20 nt, Artificial Sequence
  synthesized
ggugggaagggcucaccuag

SEQ ID NO: 57 - RNA, 20 nt, Artificial Sequence
  synthesized
gaaggaccaaggaagcagcu

SEQ ID NO: 58 - RNA, 20 nt, Artificial Sequence
  synthesized
cacauguaaucccagcacuu

SEQ ID NO: 59 - RNA, 20 nt, Artificial Sequence
  synthesized
gacauguacuggaauaagcc

SEQ ID NO: 60 - RNA, 20 nt, Artificial Sequence
  synthesized
uguguaggggggcuguggcu

SEQ ID NO: 61 - RNA, 20 nt, Artificial Sequence
  synthesized
agccucugggcucacuuucu

SEQ ID NO: 62 - RNA, 20 nt, Artificial Sequence
  synthesized
cugccuuuuggaaguagaaa

SEQ ID NO: 63 - RNA, 20 nt, Artificial Sequence
  synthesized
gccuuuuggaaguagaaacg

SEQ ID NO: 64 - RNA, 20 nt, Artificial Sequence
  synthesized
guuugggcaguauacuaagg

SEQ ID NO: 65 - RNA, 20 nt, Artificial Sequence
  synthesized
uugggcaguauacuaaggug

SEQ ID NO: 66 - RNA, 20 nt, Artificial Sequence
  synthesized
cuauguuuucugauaagcua

SEQ ID NO: 67 - RNA, 20 nt, Artificial Sequence
  synthesized
acugggagugacauccacaa

SEQ ID NO: 68 - RNA, 20 nt, Artificial Sequence
  synthesized
ugggagugacauccacaaag

SEQ ID NO: 69 - RNA, 20 nt, Artificial Sequence
  synthesized
aaugcaccauuugguagcua

SEQ ID NO: 70 - RNA, 20 nt, Artificial Sequence
  synthesized
ugcaccauuugguagcuaug

SEQ ID NO: 71 - RNA, 20 nt, Artificial Sequence
  synthesized
ugugguuggucaagugcagu

SEQ ID NO: 72 - RNA, 20 nt, Artificial Sequence
  synthesized
cacagacuuggagaagaggg

SEQ ID NO: 73 - RNA, 20 nt, Artificial Sequence
  synthesized
cucacagacuuggagaagag

SEQ ID NO: 74 - RNA, 20 nt, Artificial Sequence
  synthesized
cugccucagacuccuacucu

SEQ ID NO: 75 - RNA, 20 nt, Artificial Sequence
  synthesized
gaggccaggagcccacccuc

SEQ ID NO: 76 - RNA, 20 nt, Artificial Sequence
  synthesized
ugccucagacuccuacucuc

SEQ ID NO: 77 - RNA, 20 nt, Artificial Sequence
  synthesized
auacucaaggguuucuucca

SEQ ID NO: 78 - RNA, 20 nt, Artificial Sequence
  synthesized
gcgagaacagcacuggauac

SEQ ID NO: 79 - RNA, 20 nt, Artificial Sequence
  synthesized
ucauacucaaggguuucuuc

SEQ ID NO: 80 - RNA, 20 nt, Artificial Sequence
  synthesized
aaucuaccacuguagugugg

SEQ ID NO: 81 - RNA, 20 nt, Artificial Sequence
  synthesized
agccuccccacuaucaacac

SEQ ID NO: 82 - RNA, 20 nt, Artificial Sequence
  synthesized
uaaaucuaccacuguagugu

SEQ ID NO: 83 - RNA, 20 nt, Artificial Sequence
  synthesized
ccacacuuugaaguuggguc

SEQ ID NO: 84 - RNA, 20 nt, Artificial Sequence
  synthesized
gaacuuggcacuucaaaguc

SEQ ID NO: 85 - RNA, 20 nt, Artificial Sequence
  synthesized
cgcgggaggggagggggucu

SEQ ID NO: 86 - RNA, 20 nt, Artificial Sequence
  synthesized
cgggaggggagggggucugg

SEQ ID NO: 87 - RNA, 20 nt, Artificial Sequence
  synthesized
agucugaguuaaauguuucc

SEQ ID NO: 88 - RNA, 20 nt, Artificial Sequence
  synthesized
gacuguccccaggucuagcc

SEQ ID NO: 89 - RNA, 20 nt, Artificial Sequence
  synthesized
gagacuguccccaggucuag

SEQ ID NO: 90 - RNA, 20 nt, Artificial Sequence
  synthesized
gucccacuccuacccagggc

SEQ ID NO: 91 - RNA, 20 nt, Artificial Sequence
  synthesized
ccuggcucaggccucaggag

SEQ ID NO: 92 - RNA, 20 nt, Artificial Sequence
  synthesized
gaccuggcucaggccucagg

SEQ ID NO: 93 - RNA, 20 nt, Artificial Sequence
  synthesized
acuaugaauacguacaggca

SEQ ID NO: 94 - RNA, 20 nt, Artificial Sequence
  synthesized
gacuaugaauacguacaggc

SEQ ID NO: 95 - RNA, 20 nt, Artificial Sequence
  synthesized
ggaagccugguucacugguc

SEQ ID NO: 96 - RNA, 20 nt, Artificial Sequence
  synthesized
caccuguguauacaccagug

SEQ ID NO: 97 - RNA, 20 nt, Artificial Sequence
  synthesized
cucaccuguguauacaccag

SEQ ID NO: 98 - RNA, 20 nt, Artificial Sequence
  synthesized
aauggaagcuccucuugugu

SEQ ID NO: 99 - RNA, 20 nt, Artificial Sequence
  synthesized
uuuuauugagcgccuucuac

SEQ ID NO: 100 - RNA, 20 nt, Artificial Sequence
  synthesized
aucaaaaaaugaucugggca

SEQ ID NO: 101 - RNA, 20 nt, Artificial Sequence
  synthesized
guucacggcaaaauugagca

SEQ ID NO: 102 - RNA, 20 nt, Artificial Sequence
  synthesized
aaaccguggaguuuaaccug

SEQ ID NO: 103 - RNA, 20 nt, Artificial Sequence
  synthesized
aaacuguggaguuuaaccug

SEQ ID NO: 104 - RNA, 20 nt, Artificial Sequence
  synthesized
accguggaguuuaaccugac

SEQ ID NO: 105 - RNA, 20 nt, Artificial Sequence
  synthesized
acuguggaguuuaaccugac

SEQ ID NO: 106 - RNA, 20 nt, Artificial Sequence
  synthesized
gaaaaccguggaguuuaacc

SEQ ID NO: 107 - RNA, 20 nt, Artificial Sequence
  synthesized
gaaaacuguggaguuuaacc

SEQ ID NO: 108 - RNA, 20 nt, Artificial Sequence
  synthesized
ucaagugaggaggaaaaccg

SEQ ID NO: 109 - RNA, 20 nt, Artificial Sequence
  synthesized
ucaagugaggaggaaaacug

SEQ ID NO: 110 - RNA, 20 nt, Artificial Sequence
  synthesized
aucccacccagcuccucagg

SEQ ID NO: 111 - RNA, 20 nt, Artificial Sequence
  synthesized
gucccacccagcuccucagg

SEQ ID NO: 112 - RNA, 20 nt, Artificial Sequence
  synthesized
uaaucccacccagcuccuca

SEQ ID NO: 113 - RNA, 20 nt, Artificial Sequence
  synthesized
uagucccacccagcuccuca

SEQ ID NO: 114 - RNA, 20 nt, Artificial Sequence
  synthesized
aagggugacggcuugggaac

SEQ ID NO: 115 - RNA, 20 nt, Artificial Sequence
  synthesized
aagggugacggcuugggauc

SEQ ID NO: 116 - RNA, 20 nt, Artificial Sequence
  synthesized
cccuaguaccucaccagauc

SEQ ID NO: 117 - RNA, 20 nt, Artificial Sequence
  synthesized
cccuaguaccucaccaguuc

SEQ ID NO: 118 - RNA, 20 nt, Artificial Sequence
  synthesized
uaccucaccagaucccaagc

SEQ ID NO: 119 - RNA, 20 nt, Artificial Sequence
  synthesized
uaccucaccaguucccaagc

SEQ ID NO: 120 - RNA, 20 nt, Artificial Sequence
  synthesized
uugggaacuggugagguacu

SEQ ID NO: 121 - RNA, 20 nt, Artificial Sequence
  synthesized
uugggaucuggugagguacu

SEQ ID NO: 122 - RNA, 20 nt, Artificial Sequence
  synthesized
agucacauaagugugcaagu

SEQ ID NO: 123 - RNA, 20 nt, Artificial Sequence
  synthesized
agucacguaagugugcaagu

SEQ ID NO: 124 - RNA, 20 nt, Artificial Sequence
  synthesized
ccccuaagucacauaagugu

SEQ ID NO: 125 - RNA, 20 nt, Artificial Sequence
  synthesized
ccccuaagucacguaagugu

SEQ ID NO: 126 - RNA, 20 nt, Artificial Sequence
  synthesized
uuacgugacuuaggggcucu

SEQ ID NO: 127 - RNA, 20 nt, Artificial Sequence
  synthesized
uuaugugacuuaggggcucu

SEQ ID NO: 128 - RNA, 20 nt, Artificial Sequence
  synthesized
uugcacacuuacgugacuua

SEQ ID NO: 129 - RNA, 20 nt, Artificial Sequence
  synthesized
uugcacacuuaugugacuua

SEQ ID NO: 130 - RNA, 20 nt, Artificial Sequence
  synthesized
acccggcgucaccacacaca

SEQ ID NO: 131 - RNA, 20 nt, Artificial Sequence
  synthesized
acccggggucaccacacaca

SEQ ID NO: 132 - RNA, 20 nt, Artificial Sequence
  synthesized
caccuguguguggugacccc

SEQ ID NO: 133 - RNA, 20 nt, Artificial Sequence
  synthesized
caccuguguguggugacgcc

SEQ ID NO: 134 - RNA, 20 nt, Artificial Sequence
  synthesized
ccggcgucaccacacacagg

SEQ ID NO: 135 - RNA, 20 nt, Artificial Sequence
  synthesized
ccggggucaccacacacagg

SEQ ID NO: 136 - RNA, 20 nt, Artificial Sequence
  synthesized
gccaccuguguguggugacc

SEQ ID NO: 137 - RNA, 20 nt, Artificial Sequence
  synthesized
gccaccuguguguggugacg

SEQ ID NO: 138 - RNA, 20 nt, Artificial Sequence
  synthesized
uguguguggugaccccgggu

SEQ ID NO: 139 - RNA, 20 nt, Artificial Sequence
  synthesized
uguguguggugacgccgggu

SEQ ID NO: 140 - RNA, 20 nt, Artificial Sequence
  synthesized
acaagaagggaccaagacaa

SEQ ID NO: 141 - RNA, 20 nt, Artificial Sequence
  synthesized
acaagaagggacuaagacaa

SEQ ID NO: 142 - RNA, 20 nt, Artificial Sequence
  synthesized
caagacaaggacuccuuugu

SEQ ID NO: 143 - RNA, 20 nt, Artificial Sequence
  synthesized
cagauuacaagaagggacca

SEQ ID NO: 144 - RNA, 20 nt, Artificial Sequence
  synthesized
cagauuacaagaagggacua

SEQ ID NO: 145 - RNA, 20 nt, Artificial Sequence
  synthesized
uaagacaaggacuccuuugu

SEQ ID NO: 146 - RNA, 20 nt, Artificial Sequence
  synthesized
accucagggcauuugcacag

SEQ ID NO: 147 - RNA, 20 nt, Artificial Sequence
  synthesized
accucagggcauuuguacag

SEQ ID NO: 148 - RNA, 20 nt, Artificial Sequence
  synthesized
auuugcacagacacacaggu

SEQ ID NO: 149 - RNA, 20 nt, Artificial Sequence
  synthesized
auuuguacagacacacaggu

SEQ ID NO: 150 - RNA, 20 nt, Artificial Sequence
  synthesized
ccaccucagggcauuugcac

SEQ ID NO: 151 - RNA, 20 nt, Artificial Sequence
  synthesized
ccaccucagggcauuuguac

SEQ ID NO: 152 - RNA, 20 nt, Artificial Sequence
  synthesized
cuguacaaaugcccugaggu

SEQ ID NO: 153 - RNA, 20 nt, Artificial Sequence
  synthesized
cugugcaaaugcccugaggu

SEQ ID NO: 154 - RNA, 20 nt, Artificial Sequence
  synthesized
gcacagacacacaggugccc

SEQ ID NO: 155 - RNA, 20 nt, Artificial Sequence
  synthesized
gggcauuugcacagacacac

SEQ ID NO: 156 - RNA, 20 nt, Artificial Sequence
  synthesized
gggcauuuguacagacacac

SEQ ID NO: 157 - RNA, 20 nt, Artificial Sequence
  synthesized
guacagacacacaggugccc

SEQ ID NO: 158 - RNA, 20 nt, Artificial Sequence
  synthesized
gugucuguacaaaugcccug

SEQ ID NO: 159 - RNA, 20 nt, Artificial Sequence
  synthesized
gugucugugcaaaugcccug

SEQ ID NO: 160 - RNA, 20 nt, Artificial Sequence
  synthesized
gugugucuguacaaaugccc

SEQ ID NO: 161 - RNA, 20 nt, Artificial Sequence
  synthesized
gugugucugugcaaaugccc

SEQ ID NO: 162 - RNA, 20 nt, Artificial Sequence
  synthesized
ucccaccucagggcauuugc

SEQ ID NO: 163 - RNA, 20 nt, Artificial Sequence
  synthesized
ucccaccucagggcauuugu

SEQ ID NO: 164 - RNA, 20 nt, Artificial Sequence
  synthesized
uugcacagacacacaggugc

SEQ ID NO: 165 - RNA, 20 nt, Artificial Sequence
  synthesized
uuguacagacacacaggugc

SEQ ID NO: 166 - RNA, 20 nt, Artificial Sequence
  synthesized
cuaaucuuccugcucugcua

SEQ ID NO: 167 - RNA, 20 nt, Artificial Sequence
  synthesized
gcagagcaggaagauuaaga

SEQ ID NO: 168 - RNA, 20 nt, Artificial Sequence
  synthesized
gcagagcaggaagauuagga

SEQ ID NO: 169 - RNA, 20 nt, Artificial Sequence
  synthesized
ggaagauuaagaacucgcca

SEQ ID NO: 170 - RNA, 20 nt, Artificial Sequence
  synthesized
ggaagauuaggaacucgcca

SEQ ID NO: 171 - RNA, 20 nt, Artificial Sequence
  synthesized
uuaaucuuccugcucugcua

SEQ ID NO: 172 - RNA, 20 nt, Artificial Sequence
  synthesized
aguggagugaagaaggcagu

SEQ ID NO: 173 - RNA, 20 nt, Artificial Sequence
  synthesized
aguggagugaagaaggcggu

SEQ ID NO: 174 - RNA, 20 nt, Artificial Sequence
  synthesized
cagugggugggagaaccugc

SEQ ID NO: 175 - RNA, 20 nt, Artificial Sequence
  synthesized
cggugggugggagaaccugc

SEQ ID NO: 176 - RNA, 20 nt, Artificial Sequence
  synthesized
gagugaagaaggcagugggu

SEQ ID NO: 177 - RNA, 20 nt, Artificial Sequence
  synthesized
gagugaagaaggcggugggu

SEQ ID NO: 178 - RNA, 20 nt, Artificial Sequence
  synthesized
gugaagaaggcagugggugg

SEQ ID NO: 179 - RNA, 20 nt, Artificial Sequence
  synthesized
gugaagaaggcggugggugg

SEQ ID NO: 180 - RNA, 20 nt, Artificial Sequence
  synthesized
aaacuauuucgcaaugaccu

SEQ ID NO: 181 - RNA, 20 nt, Artificial Sequence
  synthesized
acacuauuucgcaaugaccu

SEQ ID NO: 182 - RNA, 20 nt, Artificial Sequence
  synthesized
gccuagaaaaaaaaacacua

SEQ ID NO: 183 - RNA, 20 nt, Artificial Sequence
  synthesized
uaguguuuuuuuuucuaggc

SEQ ID NO: 184 - RNA, 20 nt, Artificial Sequence
  synthesized
uuuuuuauagagacaggauc

SEQ ID NO: 185 - RNA, 20 nt, Artificial Sequence
  synthesized
aaccccaccucaggcucucg

SEQ ID NO: 186 - RNA, 20 nt, Artificial Sequence
  synthesized
aaccccaccuccggcucucg

SEQ ID NO: 187 - RNA, 20 nt, Artificial Sequence
  synthesized
agagccggaggugggguugc

SEQ ID NO: 188 - RNA, 20 nt, Artificial Sequence
  synthesized
agagccugaggugggguugc

SEQ ID NO: 189 - RNA, 20 nt, Artificial Sequence
  synthesized
caggcucucggaagacccuc

SEQ ID NO: 190 - RNA, 20 nt, Artificial Sequence
  synthesized
ccccaccucaggcucucgga

SEQ ID NO: 191 - RNA, 20 nt, Artificial Sequence
  synthesized
ccccaccuccggcucucgga

SEQ ID NO: 192 - RNA, 20 nt, Artificial Sequence
  synthesized
ccggcucucggaagacccuc

SEQ ID NO: 193 - RNA, 20 nt, Artificial Sequence
  synthesized
gagggucuuccgagagccgg

SEQ ID NO: 194 - RNA, 20 nt, Artificial Sequence
  synthesized
gagggucuuccgagagccug

SEQ ID NO: 195 - RNA, 20 nt, Artificial Sequence
  synthesized
gcaaccccaccucaggcucu

SEQ ID NO: 196 - RNA, 20 nt, Artificial Sequence
  synthesized
gcaaccccaccuccggcucu

SEQ ID NO: 197 - RNA, 20 nt, Artificial Sequence
  synthesized
gucuuccgagagccggaggu

SEQ ID NO: 198 - RNA, 20 nt, Artificial Sequence
  synthesized
gucuuccgagagccugaggu

SEQ ID NO: 199 - RNA, 20 nt, Artificial Sequence
  synthesized
acagugccccacagacaccc

SEQ ID NO: 200 - RNA, 20 nt, Artificial Sequence
  synthesized
acagugccccacagacgccc

SEQ ID NO: 201 - RNA, 20 nt, Artificial Sequence
  synthesized
gggcgucuguggggcacugu

SEQ ID NO: 202 - RNA, 20 nt, Artificial Sequence
  synthesized
gggugucuguggggcacugu

SEQ ID NO: 203 - RNA, 20 nt, Artificial Sequence
  synthesized
uggggcugaggggcgucugu

SEQ ID NO: 204 - RNA, 20 nt, Artificial Sequence
  synthesized
uggggcugaggggugucugu

SEQ ID NO: 205 - RNA, 20 nt, Artificial Sequence
  synthesized
aaggagggggccuggcauag

SEQ ID NO: 206 - RNA, 20 nt, Artificial Sequence
  synthesized
aaggagggggcuuggcauag

SEQ ID NO: 207 - RNA, 20 nt, Artificial Sequence
  synthesized
agaaagaaaaggagggggcc

SEQ ID NO: 208 - RNA, 20 nt, Artificial Sequence
  synthesized
agaaagaaaaggagggggcu

SEQ ID NO: 209 - RNA, 20 nt, Artificial Sequence
  synthesized
agcccccuccuuuucuuucu

SEQ ID NO: 210 - RNA, 20 nt, Artificial Sequence
  synthesized
aggagggggcuuggcauagc

SEQ ID NO: 211 - RNA, 20 nt, Artificial Sequence
  synthesized
caggcccccuccuuuucuuu

SEQ ID NO: 212 - RNA, 20 nt, Artificial Sequence
  synthesized
gcuuggcauagcuggacagg

SEQ ID NO: 213 - RNA, 20 nt, Artificial Sequence
  synthesized
ggagggggccuggcauagcu

SEQ ID NO: 214 - RNA, 20 nt, Artificial Sequence
  synthesized
ggagggggcuuggcauagcu

SEQ ID NO: 215 - RNA, 20 nt, Artificial Sequence
  synthesized
ggcccccuccuuuucuuucu

SEQ ID NO: 216 - RNA, 20 nt, Artificial Sequence
  synthesized
ggccuggcauagcuggacag

SEQ ID NO: 217 - RNA, 20 nt, Artificial Sequence
  synthesized
ggcuuggcauagcuggacag

SEQ ID NO: 218 - RNA, 20 nt, Artificial Sequence
  synthesized
gggcuuggcauagcuggaca

SEQ ID NO: 219 - RNA, 20 nt, Artificial Sequence
  synthesized
ggggccuggcauagcuggac

SEQ ID NO: 220 - RNA, 20 nt, Artificial Sequence
  synthesized
ggggcuuggcauagcuggac

SEQ ID NO: 221 - RNA, 20 nt, Artificial Sequence
  synthesized
aauacaaaucagcugggcgu

SEQ ID NO: 222 - RNA, 20 nt, Artificial Sequence
  synthesized
uacaaaucagcugggcgucg

SEQ ID NO: 223 - RNA, 20 nt, Artificial Sequence
  synthesized
ccggggcugguggagcgggg

SEQ ID NO: 224 - RNA, 20 nt, Artificial Sequence
  synthesized
ccggggcugguggagggggg

SEQ ID NO: 225 - RNA, 20 nt, Artificial Sequence
  synthesized
ccugccggggcugguggagc

SEQ ID NO: 226 - RNA, 20 nt, Artificial Sequence
  synthesized
ccugccggggcugguggagg

SEQ ID NO: 227 - RNA, 20 nt, Artificial Sequence
  synthesized
cugguggagcggggugaguc

SEQ ID NO: 228 - RNA, 20 nt, Artificial Sequence
  synthesized
cugguggaggggggugaguc

SEQ ID NO: 229 - RNA, 20 nt, Artificial Sequence
  synthesized
gagcggggugagucuggugg

SEQ ID NO: 230 - RNA, 20 nt, Artificial Sequence
  synthesized
gaggggggugagucuggugg

SEQ ID NO: 231 - RNA, 20 nt, Artificial Sequence
  synthesized
gcggggugagucuggugggg

SEQ ID NO: 232 - RNA, 20 nt, Artificial Sequence
  synthesized
ggggggugagucuggugggg

SEQ ID NO: 233 - RNA, 20 nt, Artificial Sequence
  synthesized
ugccggggcugguggagcgg

SEQ ID NO: 234 - RNA, 20 nt, Artificial Sequence
  synthesized
ugccggggcugguggagggg

SEQ ID NO: 235 - RNA, 20 nt, Artificial Sequence
  synthesized
uggagcggggugagucuggu

SEQ ID NO: 236 - RNA, 20 nt, Artificial Sequence
  synthesized
uggaggggggugagucuggu

SEQ ID NO: 237 - RNA, 20 nt, Artificial Sequence
  synthesized
aauugcucucagagagcgau

SEQ ID NO: 238 - RNA, 20 nt, Artificial Sequence
  synthesized
aauugcucucagagagugau

SEQ ID NO: 239 - RNA, 20 nt, Artificial Sequence
  synthesized
agagagcgauggggccuuga

SEQ ID NO: 240 - RNA, 20 nt, Artificial Sequence
  synthesized
agagagugauggggccuuga

SEQ ID NO: 241 - RNA, 20 nt, Artificial Sequence
  synthesized
agagcgauggggccuugaug

SEQ ID NO: 242 - RNA, 20 nt, Artificial Sequence
  synthesized
agagugauggggccuugaug

SEQ ID NO: 243 - RNA, 20 nt, Artificial Sequence
  synthesized
ucaaggccccaucacucucu

SEQ ID NO: 244 - RNA, 20 nt, Artificial Sequence
  synthesized
ucaaggccccaucgcucucu

SEQ ID NO: 245 - RNA, 20 nt, Artificial Sequence
  synthesized
accccaugaagcccuuccug

SEQ ID NO: 246 - RNA, 20 nt, Artificial Sequence
  synthesized
accccaugacgcccuuccug

SEQ ID NO: 247 - RNA, 20 nt, Artificial Sequence
  synthesized
caggcaggaagggcgucaug

SEQ ID NO: 248 - RNA, 20 nt, Artificial Sequence
  synthesized
caggcaggaagggcuucaug

SEQ ID NO: 249 - RNA, 20 nt, Artificial Sequence
  synthesized
cccaugaagcccuuccugcc

SEQ ID NO: 250 - RNA, 20 nt, Artificial Sequence
  synthesized
cccaugacgcccuuccugcc

SEQ ID NO: 251 - RNA, 20 nt, Artificial Sequence
  synthesized
gcgucaugggguguggaaau

SEQ ID NO: 252 - RNA, 20 nt, Artificial Sequence
  synthesized
gcuucaugggguguggaaau

SEQ ID NO: 253 - RNA, 20 nt, Artificial Sequence
  synthesized
ggaagggcgucauggggugu

SEQ ID NO: 254 - RNA, 20 nt, Artificial Sequence
  synthesized
ggaagggcuucauggggugu

SEQ ID NO: 255 - RNA, 20 nt, Artificial Sequence
  synthesized
gucaggcaggaagggcguca

SEQ ID NO: 256 - RNA, 20 nt, Artificial Sequence
  synthesized
gucaggcaggaagggcuuca

SEQ ID NO: 257 - RNA, 20 nt, Artificial Sequence
  synthesized
cacugaucacaggcuguccu

SEQ ID NO: 258 - RNA, 20 nt, Artificial Sequence
  synthesized
cacugaucauaggcuguccu

SEQ ID NO: 259 - RNA, 20 nt, Artificial Sequence
  synthesized
cagccuaugaucagugaugc

SEQ ID NO: 260 - RNA, 20 nt, Artificial Sequence
  synthesized
cagccugugaucagugaugc

SEQ ID NO: 261 - RNA, 20 nt, Artificial Sequence
  synthesized
gaaggacagccuaugaucag

SEQ ID NO: 262 - RNA, 20 nt, Artificial Sequence
  synthesized
gaaggacagccugugaucag

SEQ ID NO: 263 - RNA, 20 nt, Artificial Sequence
  synthesized
gccuaugaucagugaugcag

SEQ ID NO: 264 - RNA, 20 nt, Artificial Sequence
  synthesized
gccugugaucagugaugcag

SEQ ID NO: 265 - RNA, 20 nt, Artificial Sequence
  synthesized
uccacugcaucacugaucac

SEQ ID NO: 266 - RNA, 20 nt, Artificial Sequence
  synthesized
uccacugcaucacugaucau

SEQ ID NO: 267 - RNA, 20 nt, Artificial Sequence
  synthesized
ucgaaggacagccuaugauc

SEQ ID NO: 268 - RNA, 20 nt, Artificial Sequence
  synthesized
ucgaaggacagccugugauc

SEQ ID NO: 269 - RNA, 20 nt, Artificial Sequence
  synthesized
agccucaaacucuggauaca

SEQ ID NO: 270 - RNA, 20 nt, Artificial Sequence
  synthesized
agucucaaacucuggauaca

SEQ ID NO: 271 - RNA, 20 nt, Artificial Sequence
  synthesized
caaacccaagccucaaacuc

SEQ ID NO: 272 - RNA, 20 nt, Artificial Sequence
  synthesized
caaacccaagucucaaacuc

SEQ ID NO: 273 - RNA, 20 nt, Artificial Sequence
  synthesized
caagccucaaacucuggaua

SEQ ID NO: 274 - RNA, 20 nt, Artificial Sequence
  synthesized
caagucucaaacucuggaua

SEQ ID NO: 275 - RNA, 20 nt, Artificial Sequence
  synthesized
cagaguuugagacuuggguu

SEQ ID NO: 276 - RNA, 20 nt, Artificial Sequence
  synthesized
cagaguuugaggcuuggguu

SEQ ID NO: 277 - RNA, 20 nt, Artificial Sequence
  synthesized
gagacuuggguuugagcucc

SEQ ID NO: 278 - RNA, 20 nt, Artificial Sequence
  synthesized
gaggcuuggguuugagcucc

SEQ ID NO: 279 - RNA, 20 nt, Artificial Sequence
  synthesized
uguauccagaguuugagacu

SEQ ID NO: 280 - RNA, 20 nt, Artificial Sequence
  synthesized
uguauccagaguuugaggcu

SEQ ID NO: 281 - RNA, 20 nt, Artificial Sequence
  synthesized
aagagagguuggccggguac

SEQ ID NO: 282 - RNA, 20 nt, Artificial Sequence
  synthesized
cuguacccggccaaccucuc

SEQ ID NO: 283 - RNA, 20 nt, Artificial Sequence
  synthesized
gagagguuggccggguacag

SEQ ID NO: 284 - RNA, 20 nt, Artificial Sequence
  synthesized
aaggucccgaacacuucccu

SEQ ID NO: 285 - RNA, 20 nt, Artificial Sequence
  synthesized
aaggucccggacacuucccu

SEQ ID NO: 286 - RNA, 20 nt, Artificial Sequence
  synthesized
gaacacuucccuaggauccc

SEQ ID NO: 287 - RNA, 20 nt, Artificial Sequence
  synthesized
ggacacuucccuaggauccc

SEQ ID NO: 288 - RNA, 20 nt, Artificial Sequence
  synthesized
gggauccuagggaagugucc

SEQ ID NO: 289 - RNA, 20 nt, Artificial Sequence
  synthesized
gggauccuagggaaguguuc

SEQ ID NO: 290 - RNA, 20 nt, Artificial Sequence
  synthesized
guguccgggaccuuuucuca

SEQ ID NO: 291 - RNA, 20 nt, Artificial Sequence
  synthesized
guguucgggaccuuuucuca

SEQ ID NO: 292 - RNA, 20 nt, Artificial Sequence
  synthesized
accagggcuggaauuuagga

SEQ ID NO: 293 - RNA, 20 nt, Artificial Sequence
  synthesized
accagggcuggaauuuaggg

SEQ ID NO: 294 - RNA, 20 nt, Artificial Sequence
  synthesized
cccuaaauuccagcccuggu

SEQ ID NO: 295 - RNA, 20 nt, Artificial Sequence
  synthesized
gaggggguguugcccuaaau

SEQ ID NO: 296 - RNA, 20 nt, Artificial Sequence
  synthesized
gaggggguguuguccuaaau

SEQ ID NO: 297 - RNA, 20 nt, Artificial Sequence
  synthesized
guguugcccuaaauuccagc

SEQ ID NO: 298 - RNA, 20 nt, Artificial Sequence
  synthesized
guguuguccuaaauuccagc

SEQ ID NO: 299 - RNA, 20 nt, Artificial Sequence
  synthesized
guugcccuaaauuccagccc

SEQ ID NO: 300 - RNA, 20 nt, Artificial Sequence
  synthesized
guuguccuaaauuccagccc

SEQ ID NO: 301 - RNA, 20 nt, Artificial Sequence
  synthesized
uccuaaauuccagcccuggu

SEQ ID NO: 302 - RNA, 20 nt, Artificial Sequence
  synthesized
agccucagacuacaggcaca

SEQ ID NO: 303 - RNA, 20 nt, Artificial Sequence
  synthesized
agccucagacugcaggcaca

SEQ ID NO: 304 - RNA, 20 nt, Artificial Sequence
  synthesized
cagucugaggcugaguaucg

SEQ ID NO: 305 - RNA, 20 nt, Artificial Sequence
  synthesized
cgugugccugcagucugagg

SEQ ID NO: 306 - RNA, 20 nt, Artificial Sequence
  synthesized
cgugugccuguagucugagg

SEQ ID NO: 307 - RNA, 20 nt, Artificial Sequence
  synthesized
uagucugaggcugaguaucg

SEQ ID NO: 308 - RNA, 20 nt, Artificial Sequence
  synthesized
ugcagucugaggcugaguau

SEQ ID NO: 309 - RNA, 20 nt, Artificial Sequence
  synthesized
uguagucugaggcugaguau

SEQ ID NO: 310 - RNA, 20 nt, Artificial Sequence
  synthesized
acuugccuccacacccagcc

SEQ ID NO: 311 - RNA, 20 nt, Artificial Sequence
  synthesized
acuugccuccacacccaucc

SEQ ID NO: 312 - RNA, 20 nt, Artificial Sequence
  synthesized
gccuccacacccagcccaag

SEQ ID NO: 313 - RNA, 20 nt, Artificial Sequence
  synthesized
gccuccacacccaucccaag

SEQ ID NO: 314 - RNA, 20 nt, Artificial Sequence
  synthesized
ggauggguguggaggcaagu

SEQ ID NO: 315 - RNA, 20 nt, Artificial Sequence
  synthesized
ggcuggguguggaggcaagu

SEQ ID NO: 316 - RNA, 20 nt, Artificial Sequence
  synthesized
uaagaaucuugucuugggau

SEQ ID NO: 317 - RNA, 20 nt, Artificial Sequence
  synthesized
uaagaaucuugucuugggcu

SEQ ID NO: 318 - RNA, 20 nt, Artificial Sequence
  synthesized
ucuugucuugggaugggugu

SEQ ID NO: 319 - RNA, 20 nt, Artificial Sequence
  synthesized
ucuugucuugggcugggugu

SEQ ID NO: 320 - RNA, 20 nt, Artificial Sequence
  synthesized
ugggauggguguggaggcaa

SEQ ID NO: 321 - RNA, 20 nt, Artificial Sequence
  synthesized
ugggcuggguguggaggcaa

SEQ ID NO: 322 - RNA, 20 nt, Artificial Sequence
  synthesized
uugccuccacacccagccca

SEQ ID NO: 323 - RNA, 20 nt, Artificial Sequence
  synthesized
uugccuccacacccauccca

SEQ ID NO: 324 - RNA, 20 nt, Artificial Sequence
  synthesized
uugucuugggaugggugugg

SEQ ID NO: 325 - RNA, 20 nt, Artificial Sequence
  synthesized
uugucuugggcugggugugg

SEQ ID NO: 326 - RNA, 20 nt, Artificial Sequence
  synthesized
gaugagcuggauguagcugu

SEQ ID NO: 327 - RNA, 20 nt, Artificial Sequence
  synthesized
gaugagcuguauguagcugu

SEQ ID NO: 328 - RNA, 20 nt, Artificial Sequence
  synthesized
guauguagcugucgcaauac

SEQ ID NO: 329 - RNA, 20 nt, Artificial Sequence
  synthesized
cccuuuagaaggcagagcgg

SEQ ID NO: 330 - RNA, 20 nt, Artificial Sequence
  synthesized
cccuuuagaaggcagaucgg

SEQ ID NO: 331 - RNA, 20 nt, Artificial Sequence
  synthesized
gaucugccuucuaaagggca

SEQ ID NO: 332 - RNA, 20 nt, Artificial Sequence
  synthesized
gcucugccuucuaaagggca

SEQ ID NO: 333 - RNA, 20 nt, Artificial Sequence
  synthesized
ggugccgaucugccuucuaa

SEQ ID NO: 334 - RNA, 20 nt, Artificial Sequence
  synthesized
ggugccgcucugccuucuaa

SEQ ID NO: 335 - RNA, 20 nt, Artificial Sequence
  synthesized
uagcuaaugcacgcaaggcu

SEQ ID NO: 336 - RNA, 20 nt, Artificial Sequence
  synthesized
cugauccuuugaaugcagcc

SEQ ID NO: 337 - RNA, 20 nt, Artificial Sequence
  synthesized
cugauccuuugaaugcaucc

SEQ ID NO: 338 - RNA, 20 nt, Artificial Sequence
  synthesized
gauccuuugaaugcagccaa

SEQ ID NO: 339 - RNA, 20 nt, Artificial Sequence
  synthesized
gauccuuugaaugcauccaa

SEQ ID NO: 340 - RNA, 20 nt, Artificial Sequence
  synthesized
ggaugcauucaaaggaucag

SEQ ID NO: 341 - RNA, 20 nt, Artificial Sequence
  synthesized
ggcugcauucaaaggaucag

SEQ ID NO: 342 - RNA, 20 nt, Artificial Sequence
  synthesized
ugacccuuggaugcauucaa

SEQ ID NO: 343 - RNA, 20 nt, Artificial Sequence
  synthesized
ugacccuuggcugcauucaa

SEQ ID NO: 344 - RNA, 20 nt, Artificial Sequence
  synthesized
uuggaugcauucaaaggauc

SEQ ID NO: 345 - RNA, 20 nt, Artificial Sequence
  synthesized
uuggcugcauucaaaggauc

SEQ ID NO: 346 - RNA, 20 nt, Artificial Sequence
  synthesized
caagggcagcggcacaguca

SEQ ID NO: 347 - RNA, 20 nt, Artificial Sequence
  synthesized
caugacugugccgcugcccu

SEQ ID NO: 348 - RNA, 20 nt, Artificial Sequence
  synthesized
cccaggcucaagggcagcgg

SEQ ID NO: 349 - RNA, 20 nt, Artificial Sequence
  synthesized
ugccgcugcccuugagccug

SEQ ID NO: 350 - RNA, 20 nt, Artificial Sequence
  synthesized
ugugccgcugcccuugagcc

SEQ ID NO: 351 - RNA, 20 nt, Artificial Sequence
  synthesized
agaaacugaaguuagacguu

SEQ ID NO: 352 - RNA, 20 nt, Artificial Sequence
  synthesized
agagaaacugaaguuagacg

SEQ ID NO: 353 - RNA, 20 nt, Artificial Sequence
  synthesized
agugaaacugaaguuagacg

SEQ ID NO: 354 - RNA, 20 nt, Artificial Sequence
  synthesized
cggacugcagccagagaaac

SEQ ID NO: 355 - RNA, 20 nt, Artificial Sequence
  synthesized
cggacugcagccagugaaac

SEQ ID NO: 356 - RNA, 20 nt, Artificial Sequence
  synthesized
ugaaacugaaguuagacguu

SEQ ID NO: 357 - RNA, 20 nt, Artificial Sequence
  synthesized
cgacagccaccacgccuagc

SEQ ID NO: 358 - RNA, 20 nt, Artificial Sequence
  synthesized
gcacugggauuacaggcgag

SEQ ID NO: 359 - RNA, 20 nt, Artificial Sequence
  synthesized
uacaggcgacagccaccacg

SEQ ID NO: 360 - RNA, 20 nt, Artificial Sequence
  synthesized
uaggcgugguggcugucgcc

SEQ ID NO: 361 - RNA, 20 nt, Artificial Sequence
  synthesized
agugggguguagucaagauu

SEQ ID NO: 362 - RNA, 20 nt, Artificial Sequence
  synthesized
agugggguguggucaagauu

SEQ ID NO: 363 - RNA, 20 nt, Artificial Sequence
  synthesized
gagccaggagugggguguag

SEQ ID NO: 364 - RNA, 20 nt, Artificial Sequence
  synthesized
gagccaggaguggggugugg

SEQ ID NO: 365 - RNA, 20 nt, Artificial Sequence
  synthesized
ucuugaccacaccccacucc

SEQ ID NO: 366 - RNA, 20 nt, Artificial Sequence
  synthesized
ucuugacuacaccccacucc

SEQ ID NO: 367 - RNA, 20 nt, Artificial Sequence
  synthesized
ugggguguagucaagauuug

SEQ ID NO: 368 - RNA, 20 nt, Artificial Sequence
  synthesized
ugggguguggucaagauuug

SEQ ID NO: 369 - RNA, 20 nt, Artificial Sequence
  synthesized
agaguguuugggacgggcaa

SEQ ID NO: 370 - RNA, 20 nt, Artificial Sequence
  synthesized
agaguguuugggacgggcac

SEQ ID NO: 371 - RNA, 20 nt, Artificial Sequence
  synthesized
aguguuugggacgggcaagg

SEQ ID NO: 372 - RNA, 20 nt, Artificial Sequence
  synthesized
aguguuugggacgggcacgg

SEQ ID NO: 373 - RNA, 20 nt, Artificial Sequence
  synthesized
uuugggacgggcaagguggu

SEQ ID NO: 374 - RNA, 20 nt, Artificial Sequence
  synthesized
uuugggacgggcacgguggu

SEQ ID NO: 375 - RNA, 20 nt, Artificial Sequence
  synthesized
ccacaacccuucccacucug

SEQ ID NO: 376 - RNA, 20 nt, Artificial Sequence
  synthesized
ccacagcccuucccacucug

SEQ ID NO: 377 - RNA, 20 nt, Artificial Sequence
  synthesized
gaccacaacccuucccacuc

SEQ ID NO: 378 - RNA, 20 nt, Artificial Sequence
  synthesized
gaccacagcccuucccacuc

SEQ ID NO: 379 - RNA, 20 nt, Artificial Sequence
  synthesized
gggaagggcugugguccaca

SEQ ID NO: 380 - RNA, 20 nt, Artificial Sequence
  synthesized
gggaaggguugugguccaca

SEQ ID NO: 381 - RNA, 20 nt, Artificial Sequence
  synthesized
acauccuccuccuccuccca

SEQ ID NO: 382 - RNA, 20 nt, Artificial Sequence
  synthesized
accaccugggaggaggagga

SEQ ID NO: 383 - RNA, 20 nt, Artificial Sequence
  synthesized
auccuccuccuccucccagg

SEQ ID NO: 384 - RNA, 20 nt, Artificial Sequence
  synthesized
gaggaggaggaggaggaugu

SEQ ID NO: 385 - RNA, 20 nt, Artificial Sequence
  synthesized
ugggaggaggaggaggaugu

SEQ ID NO: 386 - RNA, 20 nt, Artificial Sequence
  synthesized
acuugggcaccaaugcaugc

SEQ ID NO: 387 - RNA, 20 nt, Artificial Sequence
  synthesized
acuugggcacuaaugcaugc

SEQ ID NO: 388 - RNA, 20 nt, Artificial Sequence
  synthesized
gcaccaaugcaugcugaaaa

SEQ ID NO: 389 - RNA, 20 nt, Artificial Sequence
  synthesized
gcacuaaugcaugcugaaaa

SEQ ID NO: 390 - RNA, 20 nt, Artificial Sequence
  synthesized
gcaugcauuagugcccaagu

SEQ ID NO: 391 - RNA, 20 nt, Artificial Sequence
  synthesized
gcaugcauuggugcccaagu

SEQ ID NO: 392 - RNA, 20 nt, Artificial Sequence
  synthesized
uuuucagcaugcauuagugc

SEQ ID NO: 393 - RNA, 20 nt, Artificial Sequence
  synthesized
uuuucagcaugcauuggugc

SEQ ID NO: 394 - RNA, 20 nt, Artificial Sequence
  synthesized
caggcccugguaccuggaga

SEQ ID NO: 395 - RNA, 20 nt, Artificial Sequence
  synthesized
caggcccugguaccuggaua

SEQ ID NO: 396 - RNA, 20 nt, Artificial Sequence
  synthesized
ccaccucuuauccagguacc

SEQ ID NO: 397 - RNA, 20 nt, Artificial Sequence
  synthesized
ccaccucuucuccagguacc

SEQ ID NO: 398 - RNA, 20 nt, Artificial Sequence
  synthesized
cucuuauccagguaccaggg

SEQ ID NO: 399 - RNA, 20 nt, Artificial Sequence
  synthesized
cucuucuccagguaccaggg

SEQ ID NO: 400 - RNA, 20 nt, Artificial Sequence
  synthesized
cugguaccuggagaagaggu

SEQ ID NO: 401 - RNA, 20 nt, Artificial Sequence
  synthesized
cugguaccuggauaagaggu

SEQ ID NO: 402 - RNA, 20 nt, Artificial Sequence
  synthesized
cuuauccagguaccagggcc

SEQ ID NO: 403 - RNA, 20 nt, Artificial Sequence
  synthesized
cuucuccagguaccagggcc

SEQ ID NO: 404 - RNA, 20 nt, Artificial Sequence
  synthesized
gaagaggugggggcgagccc

SEQ ID NO: 405 - RNA, 20 nt, Artificial Sequence
  synthesized
ggcccugguaccuggagaag

SEQ ID NO: 406 - RNA, 20 nt, Artificial Sequence
  synthesized
ggcccugguaccuggauaag

SEQ ID NO: 407 - RNA, 20 nt, Artificial Sequence
  synthesized
gguaccuggagaagaggugg

SEQ ID NO: 408 - RNA, 20 nt, Artificial Sequence
  synthesized
gguaccuggauaagaggugg

SEQ ID NO: 409 - RNA, 20 nt, Artificial Sequence
  synthesized
uaagaggugggggcgagccc

SEQ ID NO: 410 - RNA, 20 nt, Artificial Sequence
  synthesized
uaccuggagaagaggugggg

SEQ ID NO: 411 - RNA, 20 nt, Artificial Sequence
  synthesized
uaccuggauaagaggugggg

SEQ ID NO: 412 - RNA, 20 nt, Artificial Sequence
  synthesized
uacaaaaauuagcugggcuu

SEQ ID NO: 413 - RNA, 20 nt, Artificial Sequence
  synthesized
acaucuucccugccaaagca

SEQ ID NO: 414 - RNA, 20 nt, Artificial Sequence
  synthesized
acgucuucccugccaaagca

SEQ ID NO: 415 - RNA, 20 nt, Artificial Sequence
  synthesized
aucuucccugccaaagcaaa

SEQ ID NO: 416 - RNA, 20 nt, Artificial Sequence
  synthesized
gucuucccugccaaagcaaa

SEQ ID NO: 417 - RNA, 20 nt, Artificial Sequence
  synthesized
ugcuuuggcagggaagacgu

SEQ ID NO: 418 - RNA, 20 nt, Artificial Sequence
  synthesized
ugcuuuggcagggaagaugu

SEQ ID NO: 419 - RNA, 20 nt, Artificial Sequence
  synthesized
uuggcagggaagacguagau

SEQ ID NO: 420 - RNA, 20 nt, Artificial Sequence
  synthesized
uuggcagggaagauguagau

SEQ ID NO: 421 - RNA, 20 nt, Artificial Sequence
  synthesized
uuugcuuuggcagggaagac

SEQ ID NO: 422 - RNA, 20 nt, Artificial Sequence
  synthesized
uuugcuuuggcagggaagau

SEQ ID NO: 423 - RNA, 20 nt, Artificial Sequence
  synthesized
aaauggcuagcuuaauagau

SEQ ID NO: 424 - RNA, 20 nt, Artificial Sequence
  synthesized
aaucaaauggcuagcuuaau

SEQ ID NO: 425 - RNA, 20 nt, Artificial Sequence
  synthesized
agccugaaucaaauggcuag

SEQ ID NO: 426 - RNA, 20 nt, Artificial Sequence
  synthesized
agccugaaucaaaugguuag

SEQ ID NO: 427 - RNA, 20 nt, Artificial Sequence
  synthesized
ugaaucaaauggcuagcuua

SEQ ID NO: 428 - RNA, 20 nt, Artificial Sequence
  synthesized
ugaaucaaaugguuagcuua

SEQ ID NO: 429 - RNA, 20 nt, Artificial Sequence
  synthesized
uuuuaucuauuaagcuagcc

SEQ ID NO: 430 - RNA, 20 nt, Artificial Sequence
  synthesized
agaaaucuggaagauagccu

SEQ ID NO: 431 - RNA, 20 nt, Artificial Sequence
  synthesized
aggaaucuggaagauagccu

SEQ ID NO: 432 - RNA, 20 nt, Artificial Sequence
  synthesized
caacggcacuuaagaaaucu

SEQ ID NO: 433 - RNA, 20 nt, Artificial Sequence
  synthesized
caacggcacuuaaggaaucu

SEQ ID NO: 434 - RNA, 20 nt, Artificial Sequence
  synthesized
gcuaucuuccagauuccuua

SEQ ID NO: 435 - RNA, 20 nt, Artificial Sequence
  synthesized
gcuaucuuccagauuucuua

SEQ ID NO: 436 - RNA, 20 nt, Artificial Sequence
  synthesized
ggcacuuaagaaaucuggaa

SEQ ID NO: 437 - RNA, 20 nt, Artificial Sequence
  synthesized
ggcacuuaaggaaucuggaa

SEQ ID NO: 438 - RNA, 20 nt, Artificial Sequence
  synthesized
uaagaaaucuggaagauagc

SEQ ID NO: 439 - RNA, 20 nt, Artificial Sequence
  synthesized
uaaggaaucuggaagauagc

SEQ ID NO: 440 - RNA, 20 nt, Artificial Sequence
  synthesized
acccugagcucaggcagccc

SEQ ID NO: 441 - RNA, 20 nt, Artificial Sequence
  synthesized
acccugagcucaggcagccg

SEQ ID NO: 442 - RNA, 20 nt, Artificial Sequence
  synthesized
agcccugaucccugaaggac

SEQ ID NO: 443 - RNA, 20 nt, Artificial Sequence
  synthesized
aggcagcccugaucccugaa

SEQ ID NO: 444 - RNA, 20 nt, Artificial Sequence
  synthesized
agggcugccugagcucaggg

SEQ ID NO: 445 - RNA, 20 nt, Artificial Sequence
  synthesized
aucacggcugccugagcuca

SEQ ID NO: 446 - RNA, 20 nt, Artificial Sequence
  synthesized
aucagggcugccugagcuca

SEQ ID NO: 447 - RNA, 20 nt, Artificial Sequence
  synthesized
cagcccugaucccugaagga

SEQ ID NO: 448 - RNA, 20 nt, Artificial Sequence
  synthesized
cagccgugaucccugaagga

SEQ ID NO: 449 - RNA, 20 nt, Artificial Sequence
  synthesized
caggcagcccugaucccuga

SEQ ID NO: 450 - RNA, 20 nt, Artificial Sequence
  synthesized
caggcagccgugaucccuga

SEQ ID NO: 451 - RNA, 20 nt, Artificial Sequence
  synthesized
cggcugccugagcucagggu

SEQ ID NO: 452 - RNA, 20 nt, Artificial Sequence
  synthesized
cuucagggaucacggcugcc

SEQ ID NO: 453 - RNA, 20 nt, Artificial Sequence
  synthesized
cuucagggaucagggcugcc

SEQ ID NO: 454 - RNA, 20 nt, Artificial Sequence
  synthesized
gaucagggcugccugagcuc

SEQ ID NO: 455 - RNA, 20 nt, Artificial Sequence
  synthesized
gcucaggcagcccugauccc

SEQ ID NO: 456 - RNA, 20 nt, Artificial Sequence
  synthesized
gggcugccugagcucagggu

SEQ ID NO: 457 - RNA, 20 nt, Artificial Sequence
  synthesized
ucagggcugccugagcucag

SEQ ID NO: 458 - RNA, 20 nt, Artificial Sequence
  synthesized
aagagaagccugccggggcu

SEQ ID NO: 459 - RNA, 20 nt, Artificial Sequence
  synthesized
aggagaagccugccggggcu

SEQ ID NO: 460 - RNA, 20 nt, Artificial Sequence
  synthesized
gauggaaagagaagccugcc

SEQ ID NO: 461 - RNA, 20 nt, Artificial Sequence
  synthesized
gauggaaggagaagccugcc

SEQ ID NO: 462 - RNA, 20 nt, Artificial Sequence
  synthesized
ggcuucuccuuccaucucuc

SEQ ID NO: 463 - RNA, 20 nt, Artificial Sequence
  synthesized
ggcuucucuuuccaucucuc

SEQ ID NO: 464 - RNA, 20 nt, Artificial Sequence
  synthesized
aaaaauggugugugggagug

SEQ ID NO: 465 - RNA, 20 nt, Artificial Sequence
  synthesized
aaaaauggugugugggggug

SEQ ID NO: 466 - RNA, 20 nt, Artificial Sequence
  synthesized
aaauggugugugggaguggg

SEQ ID NO: 467 - RNA, 20 nt, Artificial Sequence
  synthesized
aaaugguguguggggguggg

SEQ ID NO: 468 - RNA, 20 nt, Artificial Sequence
  synthesized
gcaaaaauggugugugggag

SEQ ID NO: 469 - RNA, 20 nt, Artificial Sequence
  synthesized
gcaaaaaugguguguggggg

SEQ ID NO: 470 - RNA, 20 nt, Artificial Sequence
  synthesized
ugggagugggggacaagggg

SEQ ID NO: 471 - RNA, 20 nt, Artificial Sequence
  synthesized
ugugggagugggggacaagg

SEQ ID NO: 472 - RNA, 20 nt, Artificial Sequence
  synthesized
ugugggggugggggacaagg

SEQ ID NO: 473 - RNA, 20 nt, Artificial Sequence
  synthesized
ugugugggagugggggacaa

SEQ ID NO: 474 - RNA, 20 nt, Artificial Sequence
  synthesized
ugugugggggugggggacaa

SEQ ID NO: 475 - RNA, 20 nt, Artificial Sequence
  synthesized
caauacagagucaguuucuc

SEQ ID NO: 476 - RNA, 20 nt, Artificial Sequence
  synthesized
caauagagagucaguuucuc

SEQ ID NO: 477 - RNA, 20 nt, Artificial Sequence
  synthesized
cgcaauacagagucaguuuc

SEQ ID NO: 478 - RNA, 20 nt, Artificial Sequence
  synthesized
cgcaauagagagucaguuuc

SEQ ID NO: 479 - RNA, 20 nt, Artificial Sequence
  synthesized
cugacucucuauugcgacag

SEQ ID NO: 480 - RNA, 20 nt, Artificial Sequence
  synthesized
cugacucuguauugcgacag

SEQ ID NO: 481 - RNA, 20 nt, Artificial Sequence
  synthesized
gagaaacugacucucuauug

SEQ ID NO: 482 - RNA, 20 nt, Artificial Sequence
  synthesized
gagaaacugacucuguauug

SEQ ID NO: 483 - RNA, 20 nt, Artificial Sequence
  synthesized
ggauguagcugucgcaauag

SEQ ID NO: 484 - RNA, 20 nt, Artificial Sequence
  synthesized
uugagaaacugacucucuau

SEQ ID NO: 485 - RNA, 20 nt, Artificial Sequence
  synthesized
uugagaaacugacucuguau

SEQ ID NO: 486 - RNA, 20 nt, Artificial Sequence
  synthesized
aagcagcuggggagggaagg

SEQ ID NO: 487 - RNA, 20 nt, Artificial Sequence
  synthesized
ccaaggaagcagcuggggag

SEQ ID NO: 488 - RNA, 20 nt, Artificial Sequence
  synthesized
ggaagcagcuggggagggaa

SEQ ID NO: 489 - RNA, 20 nt, Artificial Sequence
  synthesized
ggagggaagggcucaccuag

SEQ ID NO: 490 - RNA, 20 nt, Artificial Sequence
  synthesized
ggggagggaagggcucaccu

SEQ ID NO: 491 - RNA, 20 nt, Artificial Sequence
  synthesized
aagcagcugggcaccuagug

SEQ ID NO: 492 - RNA, 20 nt, Artificial Sequence
  synthesized
aaggaagcagcugggcaccu

SEQ ID NO: 493 - RNA, 20 nt, Artificial Sequence
  synthesized
agcugggcaccuagugggaa

SEQ ID NO: 494 - RNA, 20 nt, Artificial Sequence
  synthesized
cugggcaccuagugggaagg

SEQ ID NO: 495 - RNA, 20 nt, Artificial Sequence
  synthesized
ggaagcagcugggcaccuag

SEQ ID NO: 496 - RNA, 20 nt, Artificial Sequence
  synthesized
aagcccaggaguuuaggacc

SEQ ID NO: 497 - RNA, 20 nt, Artificial Sequence
  synthesized
gagcccaggaguuuaggacc

SEQ ID NO: 498 - RNA, 20 nt, Artificial Sequence
  synthesized
gcagccucgaccucacaggc

SEQ ID NO: 499 - RNA, 20 nt, Artificial Sequence
  synthesized
gcagccuugaccucacaggc

SEQ ID NO: 500 - RNA, 20 nt, Artificial Sequence
  synthesized
aucccagcacuuuaggaggc

SEQ ID NO: 501 - RNA, 20 nt, Artificial Sequence
  synthesized
aucccagcacuuugggaggc

SEQ ID NO: 502 - RNA, 20 nt, Artificial Sequence
  synthesized
cccaaagugcugggauuaca

SEQ ID NO: 503 - RNA, 20 nt, Artificial Sequence
  synthesized
ccuaaagugcugggauuaca

SEQ ID NO: 504 - RNA, 20 nt, Artificial Sequence
  synthesized
cucagccucccaaagugcug

SEQ ID NO: 505 - RNA, 20 nt, Artificial Sequence
  synthesized
cucagccuccuaaagugcug

SEQ ID NO: 506 - RNA, 20 nt, Artificial Sequence
  synthesized
cauguacuggaauaagcccg

SEQ ID NO: 507 - RNA, 20 nt, Artificial Sequence
  synthesized
cauguacuggaauaagccug

SEQ ID NO: 508 - RNA, 20 nt, Artificial Sequence
  synthesized
aaaacauaguucuggaugac

SEQ ID NO: 509 - RNA, 20 nt, Artificial Sequence
  synthesized
aaaacauaguuguggaugac

SEQ ID NO: 510 - RNA, 20 nt, Artificial Sequence
  synthesized
aaagaaaacauaguucugga

SEQ ID NO: 511 - RNA, 20 nt, Artificial Sequence
  synthesized
aaagaaaacauaguugugga

SEQ ID NO: 512 - RNA, 20 nt, Artificial Sequence
  synthesized
gaaaagaaaacauaguucug

SEQ ID NO: 513 - RNA, 20 nt, Artificial Sequence
  synthesized
gaaaagaaaacauaguugug

SEQ ID NO: 514 - RNA, 20 nt, Artificial Sequence
  synthesized
cucgcguuucuacuuccaaa

SEQ ID NO: 515 - RNA, 20 nt, Artificial Sequence
  synthesized
cuugcguuucuacuuccaaa

SEQ ID NO: 516 - RNA, 20 nt, Artificial Sequence
  synthesized
cuuuuggaaguagaaacgca

SEQ ID NO: 517 - RNA, 20 nt, Artificial Sequence
  synthesized
cuuuuggaaguagaaacgcg

SEQ ID NO: 518 - RNA, 20 nt, Artificial Sequence
  synthesized
gaaguagaaacgcaagaaag

SEQ ID NO: 519 - RNA, 20 nt, Artificial Sequence
  synthesized
gaaguagaaacgcgagaaag

SEQ ID NO: 520 - RNA, 20 nt, Artificial Sequence
  synthesized
uggaaguagaaacgcaagaa

SEQ ID NO: 521 - RNA, 20 nt, Artificial Sequence
  synthesized
uggaaguagaaacgcgagaa

SEQ ID NO: 522 - RNA, 20 nt, Artificial Sequence
  synthesized
uucucgcguuucuacuucca

SEQ ID NO: 523 - RNA, 20 nt, Artificial Sequence
  synthesized
uucuugcguuucuacuucca

SEQ ID NO: 524 - RNA, 20 nt, Artificial Sequence
  synthesized
aagguguagcugucuuggau

SEQ ID NO: 525 - RNA, 20 nt, Artificial Sequence
  synthesized
aagguguggcugucuuggau

SEQ ID NO: 526 - RNA, 20 nt, Artificial Sequence
  synthesized
gguguagcugucuuggauuc

SEQ ID NO: 527 - RNA, 20 nt, Artificial Sequence
  synthesized
gguguggcugucuuggauuc

SEQ ID NO: 528 - RNA, 20 nt, Artificial Sequence
  synthesized
uacuaagguguagcugucuu

SEQ ID NO: 529 - RNA, 20 nt, Artificial Sequence
  synthesized
uacuaagguguggcugucuu

SEQ ID NO: 530 - RNA, 20 nt, Artificial Sequence
  synthesized
uagcugucuuggauucagau

SEQ ID NO: 531 - RNA, 20 nt, Artificial Sequence
  synthesized
uggcugucuuggauucagau

SEQ ID NO: 532 - RNA, 20 nt, Artificial Sequence
  synthesized
aagcaucauagcuuaucaga

SEQ ID NO: 533 - RNA, 20 nt, Artificial Sequence
  synthesized
aagcaucguagcuuaucaga

SEQ ID NO: 534 - RNA, 20 nt, Artificial Sequence
  synthesized
auaagcuacgaugcuuggau

SEQ ID NO: 535 - RNA, 20 nt, Artificial Sequence
  synthesized
auaagcuaugaugcuuggau

SEQ ID NO: 536 - RNA, 20 nt, Artificial Sequence
  synthesized
ccaagcaucauagcuuauca

SEQ ID NO: 537 - RNA, 20 nt, Artificial Sequence
  synthesized
ccaagcaucguagcuuauca

SEQ ID NO: 538 - RNA, 20 nt, Artificial Sequence
  synthesized
gcuacgaugcuuggauggga

SEQ ID NO: 539 - RNA, 20 nt, Artificial Sequence
  synthesized
gcuaugaugcuuggauggga

SEQ ID NO: 540 - RNA, 20 nt, Artificial Sequence
  synthesized
uacgaugcuuggaugggaag

SEQ ID NO: 541 - RNA, 20 nt, Artificial Sequence
  synthesized
uaugaugcuuggaugggaag

SEQ ID NO: 542 - RNA, 20 nt, Artificial Sequence
  synthesized
ucugauaagcuacgaugcuu

SEQ ID NO: 543 - RNA, 20 nt, Artificial Sequence
  synthesized
ucugauaagcuaugaugcuu

SEQ ID NO: 544 - RNA, 20 nt, Artificial Sequence
  synthesized
aaagagaaauuugacuuccu

SEQ ID NO: 545 - RNA, 20 nt, Artificial Sequence
  synthesized
agaaauuugacuuccuagca

SEQ ID NO: 546 - RNA, 20 nt, Artificial Sequence
  synthesized
auaaauuugacuuccuagca

SEQ ID NO: 547 - RNA, 20 nt, Artificial Sequence
  synthesized
gaagucaaauuucucuuugu

SEQ ID NO: 548 - RNA, 20 nt, Artificial Sequence
  synthesized
aggcaacauagcuaccaaau

SEQ ID NO: 549 - RNA, 20 nt, Artificial Sequence
  synthesized
aggccacauagcuaccaaau

SEQ ID NO: 550 - RNA, 20 nt, Artificial Sequence
  synthesized
auuugguagcuauguggccu

SEQ ID NO: 551 - RNA, 20 nt, Artificial Sequence
  synthesized
auuugguagcuauguugccu

SEQ ID NO: 552 - RNA, 20 nt, Artificial Sequence
  synthesized
caagugcaguagcgcacacc

SEQ ID NO: 553 - RNA, 20 nt, Artificial Sequence
  synthesized
caggugugcgcuacugcacu

SEQ ID NO: 554 - RNA, 20 nt, Artificial Sequence
  synthesized
ggugugcgcuacugcacuug

SEQ ID NO: 555 - RNA, 20 nt, Artificial Sequence
  synthesized
uacaggugugcgcuacugca

SEQ ID NO: 556 - RNA, 20 nt, Artificial Sequence
  synthesized
agagggaggggccucugaga

SEQ ID NO: 557 - RNA, 20 nt, Artificial Sequence
  synthesized
agagggaugggccucugaga

SEQ ID NO: 558 - RNA, 20 nt, Artificial Sequence
  synthesized
agggaggggccucugagaag

SEQ ID NO: 559 - RNA, 20 nt, Artificial Sequence
  synthesized
agggaugggccucugagaag

SEQ ID NO: 560 - RNA, 20 nt, Artificial Sequence
  synthesized
aucccucuucuccaagucug

SEQ ID NO: 561 - RNA, 20 nt, Artificial Sequence
  synthesized
cagacuuggagaagagggag

SEQ ID NO: 562 - RNA, 20 nt, Artificial Sequence
  synthesized
cagacuuggagaagagggau

SEQ ID NO: 563 - RNA, 20 nt, Artificial Sequence
  synthesized
ccaucccucuucuccaaguc

SEQ ID NO: 564 - RNA, 20 nt, Artificial Sequence
  synthesized
cccucccucuucuccaaguc

SEQ ID NO: 565 - RNA, 20 nt, Artificial Sequence
  synthesized
cucccucuucuccaagucug

SEQ ID NO: 566 - RNA, 20 nt, Artificial Sequence
  synthesized
acccuccgagaguaggaguc

SEQ ID NO: 567 - RNA, 20 nt, Artificial Sequence
  synthesized
acuccuacucuccggagggu

SEQ ID NO: 568 - RNA, 20 nt, Artificial Sequence
  synthesized
ccuccgagaguaggagucug

SEQ ID NO: 569 - RNA, 20 nt, Artificial Sequence
  synthesized
cgagaguaggagucugaggc

SEQ ID NO: 570 - RNA, 20 nt, Artificial Sequence
  synthesized
cucagacuccuacucucgga

SEQ ID NO: 571 - RNA, 20 nt, Artificial Sequence
  synthesized
cucggagggugggcuccugg

SEQ ID NO: 572 - RNA, 20 nt, Artificial Sequence
  synthesized
gacuccuacucucggagggu

SEQ ID NO: 573 - RNA, 20 nt, Artificial Sequence
  synthesized
gagcccacccuccgagagua

SEQ ID NO: 574 - RNA, 20 nt, Artificial Sequence
  synthesized
gagcccacccuccggagagu

SEQ ID NO: 575 - RNA, 20 nt, Artificial Sequence
  synthesized
ucagacuccuacucuccgga

SEQ ID NO: 576 - RNA, 20 nt, Artificial Sequence
  synthesized
uccggagggugggcuccugg

SEQ ID NO: 577 - RNA, 20 nt, Artificial Sequence
  synthesized
acagcacuggauaccgugga

SEQ ID NO: 578 - RNA, 20 nt, Artificial Sequence
  synthesized
agaacagcacuggauaccca

SEQ ID NO: 579 - RNA, 20 nt, Artificial Sequence
  synthesized
cagcacuggauacccaugga

SEQ ID NO: 580 - RNA, 20 nt, Artificial Sequence
  synthesized
cauggaagaaacccuugagu

SEQ ID NO: 581 - RNA, 20 nt, Artificial Sequence
  synthesized
cguggaagaaacccuugagu

SEQ ID NO: 582 - RNA, 20 nt, Artificial Sequence
  synthesized
gagaacagcacuggauaccg

SEQ ID NO: 583 - RNA, 20 nt, Artificial Sequence
  synthesized
gauacccauggaagaaaccc

SEQ ID NO: 584 - RNA, 20 nt, Artificial Sequence
  synthesized
ggauaccguggaagaaaccc

SEQ ID NO: 585 - RNA, 20 nt, Artificial Sequence
  synthesized
ggguuucuuccacgguaucc

SEQ ID NO: 586 - RNA, 20 nt, Artificial Sequence
  synthesized
caacacccccacacuacagu

SEQ ID NO: 587 - RNA, 20 nt, Artificial Sequence
  synthesized
caacacucccacacuacagu

SEQ ID NO: 588 - RNA, 20 nt, Artificial Sequence
  synthesized
ccacuguagugugggagugu

SEQ ID NO: 589 - RNA, 20 nt, Artificial Sequence
  synthesized
ccacuguagugugggggugu

SEQ ID NO: 590 - RNA, 20 nt, Artificial Sequence
  synthesized
gugugggaguguugauagug

SEQ ID NO: 591 - RNA, 20 nt, Artificial Sequence
  synthesized
guguggggguguugauagug

SEQ ID NO: 592 - RNA, 20 nt, Artificial Sequence
  synthesized
uaccacuguagugugggagu

SEQ ID NO: 593 - RNA, 20 nt, Artificial Sequence
  synthesized
uaccacuguagugugggggu

SEQ ID NO: 594 - RNA, 20 nt, Artificial Sequence
  synthesized
uagugugggaguguugauag

SEQ ID NO: 595 - RNA, 20 nt, Artificial Sequence
  synthesized
uaguguggggguguugauag

SEQ ID NO: 596 - RNA, 20 nt, Artificial Sequence
  synthesized
uguagugugggaguguugau

SEQ ID NO: 597 - RNA, 20 nt, Artificial Sequence
  synthesized
uguaguguggggguguugau

SEQ ID NO: 598 - RNA, 20 nt, Artificial Sequence
  synthesized
gauuacggguguaagccaaa

SEQ ID NO: 599 - RNA, 20 nt, Artificial Sequence
  synthesized
gauuauggguguaagccaaa

SEQ ID NO: 600 - RNA, 20 nt, Artificial Sequence
  synthesized
gggauuacggguguaagcca

SEQ ID NO: 601 - RNA, 20 nt, Artificial Sequence
  synthesized
gggauuauggguguaagcca

SEQ ID NO: 602 - RNA, 20 nt, Artificial Sequence
  synthesized
aaguuggguccggacuuuga

SEQ ID NO: 603 - RNA, 20 nt, Artificial Sequence
  synthesized
aaguugggucuggacuuuga

SEQ ID NO: 604 - RNA, 20 nt, Artificial Sequence
  synthesized
cagacccaacuucaaagugu

SEQ ID NO: 605 - RNA, 20 nt, Artificial Sequence
  synthesized
cggacccaacuucaaagugu

SEQ ID NO: 606 - RNA, 20 nt, Artificial Sequence
  synthesized
uccagacccaacuucaaagu

SEQ ID NO: 607 - RNA, 20 nt, Artificial Sequence
  synthesized
uccggacccaacuucaaagu

SEQ ID NO: 608 - RNA, 20 nt, Artificial Sequence
  synthesized
caccagacccccuccccucc

SEQ ID NO: 609 - RNA, 20 nt, Artificial Sequence
  synthesized
cgccagacccccuccccucc

SEQ ID NO: 610 - RNA, 20 nt, Artificial Sequence
  synthesized
cggauuucugggaccagcag

SEQ ID NO: 611 - RNA, 20 nt, Artificial Sequence
  synthesized
cugcuggucccagaaaucca

SEQ ID NO: 612 - RNA, 20 nt, Artificial Sequence
  synthesized
cugcuggucccagaaauccg

SEQ ID NO: 613 - RNA, 20 nt, Artificial Sequence
  synthesized
gagggggucuggcggauuuc

SEQ ID NO: 614 - RNA, 20 nt, Artificial Sequence
  synthesized
gagggggucugguggauuuc

SEQ ID NO: 615 - RNA, 20 nt, Artificial Sequence
  synthesized
gcuggucccagaaauccacc

SEQ ID NO: 616 - RNA, 20 nt, Artificial Sequence
  synthesized
gcuggucccagaaauccgcc

SEQ ID NO: 617 - RNA, 20 nt, Artificial Sequence
  synthesized
ggcggauuucugggaccagc

SEQ ID NO: 618 - RNA, 20 nt, Artificial Sequence
  synthesized
gggggucuggcggauuucug

SEQ ID NO: 619 - RNA, 20 nt, Artificial Sequence
  synthesized
gggggucugguggauuucug

SEQ ID NO: 620 - RNA, 20 nt, Artificial Sequence
  synthesized
gggucuggcggauuucuggg

SEQ ID NO: 621 - RNA, 20 nt, Artificial Sequence
  synthesized
gggucugguggauuucuggg

SEQ ID NO: 622 - RNA, 20 nt, Artificial Sequence
  synthesized
gguggauuucugggaccagc

SEQ ID NO: 623 - RNA, 20 nt, Artificial Sequence
  synthesized
uggauuucugggaccagcag

SEQ ID NO: 624 - RNA, 20 nt, Artificial Sequence
  synthesized
gaaagcuagacugaaccacu

SEQ ID NO: 625 - RNA, 20 nt, Artificial Sequence
  synthesized
gaaagcuagacugaaccauu

SEQ ID NO: 626 - RNA, 20 nt, Artificial Sequence
  synthesized
ucugaguuaaauguuuccaa

SEQ ID NO: 627 - RNA, 20 nt, Artificial Sequence
  synthesized
ucugaguuaaauguuuccag

SEQ ID NO: 628 - RNA, 20 nt, Artificial Sequence
  synthesized
uuccaaugguucagucuagc

SEQ ID NO: 629 - RNA, 20 nt, Artificial Sequence
  synthesized
uuccagugguucagucuagc

SEQ ID NO: 630 - RNA, 20 nt, Artificial Sequence
  synthesized
ucagccaagugauacacuca

SEQ ID NO: 631 - RNA, 20 nt, Artificial Sequence
  synthesized
ucagccgagugauacacuca

SEQ ID NO: 632 - RNA, 20 nt, Artificial Sequence
  synthesized
ucccugaguguaucacucgg

SEQ ID NO: 633 - RNA, 20 nt, Artificial Sequence
  synthesized
ucccugaguguaucacuugg

SEQ ID NO: 634 - RNA, 20 nt, Artificial Sequence
  synthesized
agcccagcccuggguaggag

SEQ ID NO: 635 - RNA, 20 nt, Artificial Sequence
  synthesized
agcccggcccuggguaggag

SEQ ID NO: 636 - RNA, 20 nt, Artificial Sequence
  synthesized
cacuccuacccagggccggg

SEQ ID NO: 637 - RNA, 20 nt, Artificial Sequence
  synthesized
cacuccuacccagggcuggg

SEQ ID NO: 638 - RNA, 20 nt, Artificial Sequence
  synthesized
cagggccgggcuagaccugg

SEQ ID NO: 639 - RNA, 20 nt, Artificial Sequence
  synthesized
cagggcugggcuagaccugg

SEQ ID NO: 640 - RNA, 20 nt, Artificial Sequence
  synthesized
cccagcccuggguaggagug

SEQ ID NO: 641 - RNA, 20 nt, Artificial Sequence
  synthesized
cccagggccgggcuagaccu

SEQ ID NO: 642 - RNA, 20 nt, Artificial Sequence
  synthesized
cccagggcugggcuagaccu

SEQ ID NO: 643 - RNA, 20 nt, Artificial Sequence
  synthesized
ccccaggucuagcccagccc

SEQ ID NO: 644 - RNA, 20 nt, Artificial Sequence
  synthesized
ccccaggucuagcccggccc

SEQ ID NO: 645 - RNA, 20 nt, Artificial Sequence
  synthesized
cccggcccuggguaggagug

SEQ ID NO: 646 - RNA, 20 nt, Artificial Sequence
  synthesized
cuagcccagcccuggguagg

SEQ ID NO: 647 - RNA, 20 nt, Artificial Sequence
  synthesized
cuagcccggcccuggguagg

SEQ ID NO: 648 - RNA, 20 nt, Artificial Sequence
  synthesized
cuccuacccagggccgggcu

SEQ ID NO: 649 - RNA, 20 nt, Artificial Sequence
  synthesized
cuccuacccagggcugggcu

SEQ ID NO: 650 - RNA, 20 nt, Artificial Sequence
  synthesized
gucuagcccagcccugggua

SEQ ID NO: 651 - RNA, 20 nt, Artificial Sequence
  synthesized
gucuagcccggcccugggua

SEQ ID NO: 652 - RNA, 20 nt, Artificial Sequence
  synthesized
cuuuaaaaaaaguuagggcc

SEQ ID NO: 653 - RNA, 20 nt, Artificial Sequence
  synthesized
uuuuaaaaaaaguuagggcc

SEQ ID NO: 654 - RNA, 20 nt, Artificial Sequence
  synthesized
caggagcggcccugggcugg

SEQ ID NO: 655 - RNA, 20 nt, Artificial Sequence
  synthesized
caggaggggcccugggcugg

SEQ ID NO: 656 - RNA, 20 nt, Artificial Sequence
  synthesized
ccagcccagggccccuccug

SEQ ID NO: 657 - RNA, 20 nt, Artificial Sequence
  synthesized
ccagcccagggccgcuccug

SEQ ID NO: 658 - RNA, 20 nt, Artificial Sequence
  synthesized
cccagggccccuccugaggc

SEQ ID NO: 659 - RNA, 20 nt, Artificial Sequence
  synthesized
cccagggccgcuccugaggc

SEQ ID NO: 660 - RNA, 20 nt, Artificial Sequence
  synthesized
ccccagcccagggccccucc

SEQ ID NO: 661 - RNA, 20 nt, Artificial Sequence
  synthesized
ccccagcccagggccgcucc

SEQ ID NO: 662 - RNA, 20 nt, Artificial Sequence
  synthesized
cggcccugggcuggggaaaa

SEQ ID NO: 663 - RNA, 20 nt, Artificial Sequence
  synthesized
cucaggagcggcccugggcu

SEQ ID NO: 664 - RNA, 20 nt, Artificial Sequence
  synthesized
cucaggaggggcccugggcu

SEQ ID NO: 665 - RNA, 20 nt, Artificial Sequence
  synthesized
gggcccugggcuggggaaaa

SEQ ID NO: 666 - RNA, 20 nt, Artificial Sequence
  synthesized
ucaggccucaggagcggccc

SEQ ID NO: 667 - RNA, 20 nt, Artificial Sequence
  synthesized
ucaggccucaggaggggccc

SEQ ID NO: 668 - RNA, 20 nt, Artificial Sequence
  synthesized
aauacguacaggcaggaauc

SEQ ID NO: 669 - RNA, 20 nt, Artificial Sequence
  synthesized
augaauacguacaggcagaa

SEQ ID NO: 670 - RNA, 20 nt, Artificial Sequence
  synthesized
augaauacguacaggcagga

SEQ ID NO: 671 - RNA, 20 nt, Artificial Sequence
  synthesized
gauuccugccuguacguauu

SEQ ID NO: 672 - RNA, 20 nt, Artificial Sequence
  synthesized
gccuaaucugauuccugccu

SEQ ID NO: 673 - RNA, 20 nt, Artificial Sequence
  synthesized
gccuaaucugauuucugccu

SEQ ID NO: 674 - RNA, 20 nt, Artificial Sequence
  synthesized
guacaggcagaaaucagauu

SEQ ID NO: 675 - RNA, 20 nt, Artificial Sequence
  synthesized
guacaggcaggaaucagauu

SEQ ID NO: 676 - RNA, 20 nt, Artificial Sequence
  synthesized
ucugauuccugccuguacgu

SEQ ID NO: 677 - RNA, 20 nt, Artificial Sequence
  synthesized
ucugauuucugccuguacgu

SEQ ID NO: 678 - RNA, 20 nt, Artificial Sequence
  synthesized
cugauccugaccagugaacc

SEQ ID NO: 679 - RNA, 20 nt, Artificial Sequence
  synthesized
cugaucuugaccagugaacc

SEQ ID NO: 680 - RNA, 20 nt, Artificial Sequence
  synthesized
cugguucacuggucaagauc

SEQ ID NO: 681 - RNA, 20 nt, Artificial Sequence
  synthesized
cugguucacuggucaggauc

SEQ ID NO: 682 - RNA, 20 nt, Artificial Sequence
  synthesized
ggucugcacugauccugacc

SEQ ID NO: 683 - RNA, 20 nt, Artificial Sequence
  synthesized
ggucugcacugaucuugacc

SEQ ID NO: 684 - RNA, 20 nt, Artificial Sequence
  synthesized
ucaagaucagugcagaccac

SEQ ID NO: 685 - RNA, 20 nt, Artificial Sequence
  synthesized
ucaggaucagugcagaccac

SEQ ID NO: 686 - RNA, 20 nt, Artificial Sequence
  synthesized
ucugcacugauccugaccag

SEQ ID NO: 687 - RNA, 20 nt, Artificial Sequence
  synthesized
ucugcacugaucuugaccag

SEQ ID NO: 688 - RNA, 20 nt, Artificial Sequence
  synthesized
accacugguguauacacagg

SEQ ID NO: 689 - RNA, 20 nt, Artificial Sequence
  synthesized
agugggauacuaauccaguc

SEQ ID NO: 690 - RNA, 20 nt, Artificial Sequence
  synthesized
agugguauacuaauccaguc

SEQ ID NO: 691 - RNA, 20 nt, Artificial Sequence
  synthesized
auaccacugguguauacaca

SEQ ID NO: 692 - RNA, 20 nt, Artificial Sequence
  synthesized
aucccacugguguauacaca

SEQ ID NO: 693 - RNA, 20 nt, Artificial Sequence
  synthesized
caccagugggauacuaaucc

SEQ ID NO: 694 - RNA, 20 nt, Artificial Sequence
  synthesized
caccagugguauacuaaucc

SEQ ID NO: 695 - RNA, 20 nt, Artificial Sequence
  synthesized
cccacugguguauacacagg

SEQ ID NO: 696 - RNA, 20 nt, Artificial Sequence
  synthesized
gacuggauuaguauaccacu

SEQ ID NO: 697 - RNA, 20 nt, Artificial Sequence
  synthesized
gacuggauuaguaucccacu

SEQ ID NO: 698 - RNA, 20 nt, Artificial Sequence
  synthesized
ugggauacuaauccagucgu

SEQ ID NO: 699 - RNA, 20 nt, Artificial Sequence
  synthesized
ugguauacuaauccagucgu

SEQ ID NO: 700 - RNA, 20 nt, Artificial Sequence
  synthesized
uguguauacaccagugggau

SEQ ID NO: 701 - RNA, 20 nt, Artificial Sequence
  synthesized
uguguauacaccagugguau

SEQ ID NO: 702 - RNA, 20 nt, Artificial Sequence
  synthesized
cauccuguauaauuucaagu

SEQ ID NO: 703 - RNA, 20 nt, Artificial Sequence
  synthesized
ggcagacauccuguauaauu

SEQ ID NO: 704 - RNA, 20 nt, Artificial Sequence
  synthesized
ggcagauauccuguauaauu

SEQ ID NO: 705 - RNA, 20 nt, Artificial Sequence
  synthesized
agcuccucuuguguucucgu

SEQ ID NO: 706 - RNA, 20 nt, Artificial Sequence
  synthesized
agcuccucuuguguucuugu

SEQ ID NO: 707 - RNA, 20 nt, Artificial Sequence
  synthesized
ccucuuguguucucguagaa

SEQ ID NO: 708 - RNA, 20 nt, Artificial Sequence
  synthesized
ccucuuguguucuuguagaa

SEQ ID NO: 709 - RNA, 20 nt, Artificial Sequence
  synthesized
ccuucuacaagaacacaaga

SEQ ID NO: 710 - RNA, 20 nt, Artificial Sequence
  synthesized
ccuucuacgagaacacaaga

SEQ ID NO: 711 - RNA, 20 nt, Artificial Sequence
  synthesized
uuauugagcgccuucuacaa

SEQ ID NO: 712 - RNA, 20 nt, Artificial Sequence
  synthesized
uuauugagcgccuucuacga

SEQ ID NO: 713 - RNA, 20 nt, Artificial Sequence
  synthesized
uuguguucucguagaaggcg

SEQ ID NO: 714 - RNA, 20 nt, Artificial Sequence
  synthesized
uuguguucuuguagaaggcg

SEQ ID NO: 715 - RNA, 20 nt, Artificial Sequence
  synthesized
auauccgucagguuaaacuc

SEQ ID NO: 716 - RNA, 20 nt, Artificial Sequence
  synthesized
uaucucaagugaggaggaaa

SEQ ID NO: 717 - RNA, 20 nt, Artificial Sequence
  synthesized
cuccugaggagcuggguggg

SEQ ID NO: 718 - RNA, 20 nt, Artificial Sequence
  synthesized
aaagaagggugacggcuugg

SEQ ID NO: 719 - RNA, 20 nt, Artificial Sequence
  synthesized
agaagggugacggcuuggga

SEQ ID NO: 720 - RNA, 20 nt, Artificial Sequence
  synthesized
aguagacccuaguaccucac

SEQ ID NO: 721 - RNA, 20 nt, Artificial Sequence
  synthesized
uagacccuaguaccucacca

SEQ ID NO: 722 - RNA, 20 nt, Artificial Sequence
  synthesized
ccuuguucugacuugcacac

SEQ ID NO: 723 - RNA, 20 nt, Artificial Sequence
  synthesized
guuaacagagccccuaaguc

SEQ ID NO: 724 - RNA, 20 nt, Artificial Sequence
  synthesized
uaacagagccccuaagucac

SEQ ID NO: 725 - RNA, 20 nt, Artificial Sequence
  synthesized
uuguucugacuugcacacuu

SEQ ID NO: 726 - RNA, 20 nt, Artificial Sequence
  synthesized
ccuugccaccuguguguggu

SEQ ID NO: 727 - RNA, 20 nt, Artificial Sequence
  synthesized
uugccaccugugugugguga

SEQ ID NO: 728 - RNA, 20 nt, Artificial Sequence
  synthesized
ugagcagauuacaagaaggg

SEQ ID NO: 729 - RNA, 20 nt, Artificial Sequence
  synthesized
gugggcaccugugugucugu

SEQ ID NO: 730 - RNA, 20 nt, Artificial Sequence
  synthesized
gugugggcaccugugugucu

SEQ ID NO: 731 - RNA, 20 nt, Artificial Sequence
  synthesized
agcugcuauauggcgaguuc

SEQ ID NO: 732 - RNA, 20 nt, Artificial Sequence
  synthesized
caagcugcuauauggcgagu

SEQ ID NO: 733 - RNA, 20 nt, Artificial Sequence
  synthesized
guaguagcagagcaggaaga

SEQ ID NO: 734 - RNA, 20 nt, Artificial Sequence
  synthesized
cugcagguucucccacccac

SEQ ID NO: 735 - RNA, 20 nt, Artificial Sequence
  synthesized
uucugcagguucucccaccc

SEQ ID NO: 736 - RNA, 20 nt, Artificial Sequence
  synthesized
caaggucauugcgaaauagu

SEQ ID NO: 737 - RNA, 20 nt, Artificial Sequence
  synthesized
uucaaggucauugcgaaaua

SEQ ID NO: 738 - RNA, 20 nt, Artificial Sequence
  synthesized
aacauagggagauccugauc

SEQ ID NO: 739 - RNA, 20 nt, Artificial Sequence
  synthesized
aaaagauucugcaaccccac

SEQ ID NO: 740 - RNA, 20 nt, Artificial Sequence
  synthesized
aagauucugcaaccccaccu

SEQ ID NO: 741 - RNA, 20 nt, Artificial Sequence
  synthesized
cccugagggucuuccgagag

SEQ ID NO: 742 - RNA, 20 nt, Artificial Sequence
  synthesized
caugggaguggggcugaggg

SEQ ID NO: 743 - RNA, 20 nt, Artificial Sequence
  synthesized
gcuacuacagugccccacag

SEQ ID NO: 744 - RNA, 20 nt, Artificial Sequence
  synthesized
uacuacagugccccacagac

SEQ ID NO: 745 - RNA, 20 nt, Artificial Sequence
  synthesized
aagaaagaaaaggagggggc

SEQ ID NO: 746 - RNA, 20 nt, Artificial Sequence
  synthesized
accccuguccagcuaugcca

SEQ ID NO: 747 - RNA, 20 nt, Artificial Sequence
  synthesized
ccaagaaagaaaaggagggg

SEQ ID NO: 748 - RNA, 20 nt, Artificial Sequence
  synthesized
gcaccccuguccagcuaugc

SEQ ID NO: 749 - RNA, 20 nt, Artificial Sequence
  synthesized
gccaagaaagaaaaggaggg

SEQ ID NO: 750 - RNA, 20 nt, Artificial Sequence
  synthesized
acccccaccagacucacccc

SEQ ID NO: 751 - RNA, 20 nt, Artificial Sequence
  synthesized
caacccccaccagacucacc

SEQ ID NO: 752 - RNA, 20 nt, Artificial Sequence
  synthesized
gaagccugccggggcuggug

SEQ ID NO: 753 - RNA, 20 nt, Artificial Sequence
  synthesized
gggugcuccaucaaggcccc

SEQ ID NO: 754 - RNA, 20 nt, Artificial Sequence
  synthesized
gugcuccaucaaggccccau

SEQ ID NO: 755 - RNA, 20 nt, Artificial Sequence
  synthesized
acaguggucaggcaggaagg

SEQ ID NO: 756 - RNA, 20 nt, Artificial Sequence
  synthesized
aguggucaggcaggaagggc

SEQ ID NO: 757 - RNA, 20 nt, Artificial Sequence
  synthesized
ugcuauuuccacaccccaug

SEQ ID NO: 758 - RNA, 20 nt, Artificial Sequence
  synthesized
acguuccacugcaucacuga

SEQ ID NO: 759 - RNA, 20 nt, Artificial Sequence
  synthesized
guuccacugcaucacugauc

SEQ ID NO: 760 - RNA, 20 nt, Artificial Sequence
  synthesized
ugcuacucgaaggacagccu

SEQ ID NO: 761 - RNA, 20 nt, Artificial Sequence
  synthesized
uuugcuacucgaaggacagc

SEQ ID NO: 762 - RNA, 20 nt, Artificial Sequence
  synthesized
accuuguauccagaguuuga

SEQ ID NO: 763 - RNA, 20 nt, Artificial Sequence
  synthesized
auggagggagcucaaaccca

SEQ ID NO: 764 - RNA, 20 nt, Artificial Sequence
  synthesized
ggagggagcucaaacccaag

SEQ ID NO: 765 - RNA, 20 nt, Artificial Sequence
  synthesized
guaccuuguauccagaguuu

SEQ ID NO: 766 - RNA, 20 nt, Artificial Sequence
  synthesized
uuaaagagagguuggccggg

SEQ ID NO: 767 - RNA, 20 nt, Artificial Sequence
  synthesized
aaagagagguuggccgggug

SEQ ID NO: 768 - RNA, 20 nt, Artificial Sequence
  synthesized
acugcacccggccaaccucu

SEQ ID NO: 769 - RNA, 20 nt, Artificial Sequence
  synthesized
agagagguuggccgggugca

SEQ ID NO: 770 - RNA, 20 nt, Artificial Sequence
  synthesized
agagguuggccgggugcagu

SEQ ID NO: 771 - RNA, 20 nt, Artificial Sequence
  synthesized
agccacugcacccggccaac

SEQ ID NO: 772 - RNA, 20 nt, Artificial Sequence
  synthesized
cacccggccaaccucucuuu

SEQ ID NO: 773 - RNA, 20 nt, Artificial Sequence
  synthesized
ccacugcacccggccaaccu

SEQ ID NO: 774 - RNA, 20 nt, Artificial Sequence
  synthesized
ugcacccggccaaccucucu

SEQ ID NO: 775 - RNA, 20 nt, Artificial Sequence
  synthesized
cacagggauccuagggaagu

SEQ ID NO: 776 - RNA, 20 nt, Artificial Sequence
  synthesized
cagggauccuagggaagugu

SEQ ID NO: 777 - RNA, 20 nt, Artificial Sequence
  synthesized
ccaugguagaggggguguug

SEQ ID NO: 778 - RNA, 20 nt, Artificial Sequence
  synthesized
ggccaugguagagggggugu

SEQ ID NO: 779 - RNA, 20 nt, Artificial Sequence
  synthesized
cccgauacucagccucagac

SEQ ID NO: 780 - RNA, 20 nt, Artificial Sequence
  synthesized
cucccgauacucagccucag

SEQ ID NO: 781 - RNA, 20 nt, Artificial Sequence
  synthesized
auccacuugccuccacaccc

SEQ ID NO: 782 - RNA, 20 nt, Artificial Sequence
  synthesized
uuuaagaaucuugucuuggg

SEQ ID NO: 783 - RNA, 20 nt, Artificial Sequence
  synthesized
acgaaggaaauggggaugag

SEQ ID NO: 784 - RNA, 20 nt, Artificial Sequence
  synthesized
ccccugcccuuuagaaggca

SEQ ID NO: 785 - RNA, 20 nt, Artificial Sequence
  synthesized
ccugcccuuuagaaggcaga

SEQ ID NO: 786 - RNA, 20 nt, Artificial Sequence
  synthesized
gaauaaggagagguggugcc

SEQ ID NO: 787 - RNA, 20 nt, Artificial Sequence
  synthesized
uugaauaaggagagguggug

SEQ ID NO: 788 - RNA, 20 nt, Artificial Sequence
  synthesized
cacccugauccuuugaaugc

SEQ ID NO: 789 - RNA, 20 nt, Artificial Sequence
  synthesized
gacacccugauccuuugaau

SEQ ID NO: 790 - RNA, 20 nt, Artificial Sequence
  synthesized
uuuaaacaacugacccuugg

SEQ ID NO: 791 - RNA, 20 nt, Artificial Sequence
  synthesized
cuguuacccaggcucaaggg

SEQ ID NO: 792 - RNA, 20 nt, Artificial Sequence
  synthesized
guuacccaggcucaagggca

SEQ ID NO: 793 - RNA, 20 nt, Artificial Sequence
  synthesized
accuaacgucuaacuucagu

SEQ ID NO: 794 - RNA, 20 nt, Artificial Sequence
  synthesized
cuaacgucuaacuucaguuu

SEQ ID NO: 795 - RNA, 20 nt, Artificial Sequence
  synthesized
gguggagccaggaguggggu

SEQ ID NO: 796 - RNA, 20 nt, Artificial Sequence
  synthesized
uggagccaggaguggggugu

SEQ ID NO: 797 - RNA, 20 nt, Artificial Sequence
  synthesized
aaacagaguguuugggacgg

SEQ ID NO: 798 - RNA, 20 nt, Artificial Sequence
  synthesized
acagaguguuugggacgggc

SEQ ID NO: 799 - RNA, 20 nt, Artificial Sequence
  synthesized
aaccuuguuuccuguggacc

SEQ ID NO: 800 - RNA, 20 nt, Artificial Sequence
  synthesized
ccuuguuuccuguggaccac

SEQ ID NO: 801 - RNA, 20 nt, Artificial Sequence
  synthesized
cugccgcagagugggaaggg

SEQ ID NO: 802 - RNA, 20 nt, Artificial Sequence
  synthesized
ggcugccgcagagugggaag

SEQ ID NO: 803 - RNA, 20 nt, Artificial Sequence
  synthesized
accuagcccuuugcuaccac

SEQ ID NO: 804 - RNA, 20 nt, Artificial Sequence
  synthesized
agcccuuugcuaccacaucc

SEQ ID NO: 805 - RNA, 20 nt, Artificial Sequence
  synthesized
aggaggaggaggauguggua

SEQ ID NO: 806 - RNA, 20 nt, Artificial Sequence
  synthesized
aggaggaugugguagcaaag

SEQ ID NO: 807 - RNA, 20 nt, Artificial Sequence
  synthesized
augugguagcaaagggcuag

SEQ ID NO: 808 - RNA, 20 nt, Artificial Sequence
  synthesized
ccaccuagcccuuugcuacc

SEQ ID NO: 809 - RNA, 20 nt, Artificial Sequence
  synthesized
cccuuugcuaccacauccuc

SEQ ID NO: 810 - RNA, 20 nt, Artificial Sequence
  synthesized
cuagcccuuugcuaccacau

SEQ ID NO: 811 - RNA, 20 nt, Artificial Sequence
  synthesized
cuuugcuaccacauccuccu

SEQ ID NO: 812 - RNA, 20 nt, Artificial Sequence
  synthesized
gaggaggaggaugugguagc

SEQ ID NO: 813 - RNA, 20 nt, Artificial Sequence
  synthesized
gaggaugugguagcaaaggg

SEQ ID NO: 814 - RNA, 20 nt, Artificial Sequence
  synthesized
gcuaccacauccuccuccuc

SEQ ID NO: 815 - RNA, 20 nt, Artificial Sequence
  synthesized
ggaggaggaggaggaugugg

SEQ ID NO: 816 - RNA, 20 nt, Artificial Sequence
  synthesized
uaccacauccuccuccuccu

SEQ ID NO: 817 - RNA, 20 nt, Artificial Sequence
  synthesized
uugcuaccacauccuccucc

SEQ ID NO: 818 - RNA, 20 nt, Artificial Sequence
  synthesized
cugacucuuuuucagcaugc

SEQ ID NO: 819 - RNA, 20 nt, Artificial Sequence
  synthesized
ucuuugguuuuuacuugggc

SEQ ID NO: 820 - RNA, 20 nt, Artificial Sequence
  synthesized
uuugguuuuuacuugggcac

SEQ ID NO: 821 - RNA, 20 nt, Artificial Sequence
  synthesized
accaggcccugguaccugga

SEQ ID NO: 822 - RNA, 20 nt, Artificial Sequence
  synthesized
cccugggcucgcccccaccu

SEQ ID NO: 823 - RNA, 20 nt, Artificial Sequence
  synthesized
cugggcucgcccccaccucu

SEQ ID NO: 824 - RNA, 20 nt, Artificial Sequence
  synthesized
guaccaggcccugguaccug

SEQ ID NO: 825 - RNA, 20 nt, Artificial Sequence
  synthesized
caaugcacacgccuaucuac

SEQ ID NO: 826 - RNA, 20 nt, Artificial Sequence
  synthesized
ccuuugcuuuggcagggaag

SEQ ID NO: 827 - RNA, 20 nt, Artificial Sequence
  synthesized
ggcaaugcacacgccuaucu

SEQ ID NO: 828 - RNA, 20 nt, Artificial Sequence
  synthesized
caacagccugaaucaaaugg

SEQ ID NO: 829 - RNA, 20 nt, Artificial Sequence
  synthesized
uacaacagccugaaucaaau

SEQ ID NO: 830 - RNA, 20 nt, Artificial Sequence
  synthesized
acugaacaacggcacuuaag

SEQ ID NO: 831 - RNA, 20 nt, Artificial Sequence
  synthesized
auccaggcuaucuuccagau

SEQ ID NO: 832 - RNA, 20 nt, Artificial Sequence
  synthesized
cuauccaggcuaucuuccag

SEQ ID NO: 833 - RNA, 20 nt, Artificial Sequence
  synthesized
cacccugagcucaggcagcc

SEQ ID NO: 834 - RNA, 20 nt, Artificial Sequence
  synthesized
cuccacccugagcucaggca

SEQ ID NO: 835 - RNA, 20 nt, Artificial Sequence
  synthesized
uccacccugagcucaggcag

SEQ ID NO: 836 - RNA, 20 nt, Artificial Sequence
  synthesized
uuacuccguccuucagggau

SEQ ID NO: 837 - RNA, 20 nt, Artificial Sequence
  synthesized
uuuacuccguccuucaggga

SEQ ID NO: 838 - RNA, 20 nt, Artificial Sequence
  synthesized
caccagccccggcaggcuuc

SEQ ID NO: 839 - RNA, 20 nt, Artificial Sequence
  synthesized
ccagccccggcaggcuucuc

SEQ ID NO: 840 - RNA, 20 nt, Artificial Sequence
  synthesized
uaaguugcuucagagagaug

SEQ ID NO: 841 - RNA, 20 nt, Artificial Sequence
  synthesized
auacaaugacaaaggcagua

SEQ ID NO: 842 - RNA, 20 nt, Artificial Sequence
  synthesized
cugccuuugucauuguauua

SEQ ID NO: 843 - RNA, 20 nt, Artificial Sequence
  synthesized
cuguuacugccuuugucauu

SEQ ID NO: 844 - RNA, 20 nt, Artificial Sequence
  synthesized
gccuuugucauuguauuauu

SEQ ID NO: 845 - RNA, 20 nt, Artificial Sequence
  synthesized
guuacugccuuugucauugu

SEQ ID NO: 846 - RNA, 20 nt, Artificial Sequence
  synthesized
uaauacaaugacaaaggcag

SEQ ID NO: 847 - RNA, 20 nt, Artificial Sequence
  synthesized
uacugccuuugucauuguau

SEQ ID NO: 848 - RNA, 20 nt, Artificial Sequence
  synthesized
cacugugacacacacacaca

SEQ ID NO: 849 - RNA, 20 nt, Artificial Sequence
  synthesized
cccuuccugucacugugaca

SEQ ID NO: 850 - RNA, 20 nt, Artificial Sequence
  synthesized
cugucacugugacacacaca

SEQ ID NO: 851 - RNA, 20 nt, Artificial Sequence
  synthesized
cuuccugucacugugacaca

SEQ ID NO: 852 - RNA, 20 nt, Artificial Sequence
  synthesized
gucacugugacacacacaca

SEQ ID NO: 853 - RNA, 20 nt, Artificial Sequence
  synthesized
ucacagugacaggaagggca

SEQ ID NO: 854 - RNA, 20 nt, Artificial Sequence
  synthesized
uccugucacugugacacaca

SEQ ID NO: 855 - RNA, 20 nt, Artificial Sequence
  synthesized
ucucugcccuuccugucacu

SEQ ID NO: 856 - RNA, 20 nt, Artificial Sequence
  synthesized
ucugcccuuccugucacugu

SEQ ID NO: 857 - RNA, 20 nt, Artificial Sequence
  synthesized
ugcccuuccugucacuguga

SEQ ID NO: 858 - RNA, 20 nt, Artificial Sequence
  synthesized
ugucacagugacaggaaggg

SEQ ID NO: 859 - RNA, 20 nt, Artificial Sequence
  synthesized
ugugucacagugacaggaag

SEQ ID NO: 860 - RNA, 20 nt, Artificial Sequence
  synthesized
ugugugugucacagugacag

SEQ ID NO: 861 - RNA, 20 nt, Artificial Sequence
  synthesized
ugugugugugugucacagug

SEQ ID NO: 862 - RNA, 20 nt, Artificial Sequence
  synthesized
cucuguauugcgacagcuac

SEQ ID NO: 863 - RNA, 20 nt, Artificial Sequence
  synthesized
cuguauugcgacagcuacau

SEQ ID NO: 864 - RNA, 20 nt, Artificial Sequence
  synthesized
agcuggauguagcugucgca

SEQ ID NO: 865 - RNA, 20 nt, Artificial Sequence
  synthesized
guauugcgacagcuacaucc

SEQ ID NO: 866 - RNA, 20 nt, Artificial Sequence
  synthesized
auguuugagaaacugacucu

SEQ ID NO: 867 - RNA, 20 nt, Artificial Sequence
  synthesized
ugauguuugagaaacugacu

SEQ ID NO: 868 - RNA, 20 nt, Artificial Sequence
  synthesized
uagccucuaggugagcccuu

SEQ ID NO: 869 - RNA, 20 nt, Artificial Sequence
  synthesized
gccucuaggugagcccuucc

SEQ ID NO: 870 - RNA, 20 nt, Artificial Sequence
  synthesized
aaggaagcagcugggguggg

SEQ ID NO: 871 - RNA, 20 nt, Artificial Sequence
  synthesized
agcuggggugggaagggcuc

SEQ ID NO: 872 - RNA, 20 nt, Artificial Sequence
  synthesized
aggugagcccuucccacccc

SEQ ID NO: 873 - RNA, 20 nt, Artificial Sequence
  synthesized
caccccagcugcuuccuugg

SEQ ID NO: 874 - RNA, 20 nt, Artificial Sequence
  synthesized
cccaccccagcugcuuccuu

SEQ ID NO: 875 - RNA, 20 nt, Artificial Sequence
  synthesized
ccuucccaccccagcugcuu

SEQ ID NO: 876 - RNA, 20 nt, Artificial Sequence
  synthesized
cuaggugagcccuucccacc

SEQ ID NO: 877 - RNA, 20 nt, Artificial Sequence
  synthesized
cucuaggugagcccuuccca

SEQ ID NO: 878 - RNA, 20 nt, Artificial Sequence
  synthesized
cuggggugggaagggcucac

SEQ ID NO: 879 - RNA, 20 nt, Artificial Sequence
  synthesized
gagcccuucccaccccagcu

SEQ ID NO: 880 - RNA, 20 nt, Artificial Sequence
  synthesized
gcagcuggggugggaagggc

SEQ ID NO: 881 - RNA, 20 nt, Artificial Sequence
  synthesized
gcccuucccaccccagcugc

SEQ ID NO: 882 - RNA, 20 nt, Artificial Sequence
  synthesized
gugagcccuucccaccccag

SEQ ID NO: 883 - RNA, 20 nt, Artificial Sequence
  synthesized
uucccaccccagcugcuucc

SEQ ID NO: 884 - RNA, 20 nt, Artificial Sequence
  synthesized
cucagguccuaaacuccugg

SEQ ID NO: 885 - RNA, 20 nt, Artificial Sequence
  synthesized
gauggcugaagccugugagg

SEQ ID NO: 886 - RNA, 20 nt, Artificial Sequence
  synthesized
uggcugaagccugugagguc

SEQ ID NO: 887 - RNA, 20 nt, Artificial Sequence
  synthesized
cggacauguacuggaauaag

SEQ ID NO: 888 - RNA, 20 nt, Artificial Sequence
  synthesized
gcuguguaggggggcugugg

SEQ ID NO: 889 - RNA, 20 nt, Artificial Sequence
  synthesized
aggaccuggcucuugucauc

SEQ ID NO: 890 - RNA, 20 nt, Artificial Sequence
  synthesized
gaccuggcucuugucaucca

SEQ ID NO: 891 - RNA, 20 nt, Artificial Sequence
  synthesized
gcagccucugggcucacuuu

SEQ ID NO: 892 - RNA, 20 nt, Artificial Sequence
  synthesized
cuaucugaauccaagacagc

SEQ ID NO: 893 - RNA, 20 nt, Artificial Sequence
  synthesized
uucuaucugaauccaagaca

SEQ ID NO: 894 - RNA, 20 nt, Artificial Sequence
  synthesized
aacuauguuuucugauaagc

SEQ ID NO: 895 - RNA, 20 nt, Artificial Sequence
  synthesized
cuuccacuucccauccaagc

SEQ ID NO: 896 - RNA, 20 nt, Artificial Sequence
  synthesized
uccacuucccauccaagcau

SEQ ID NO: 897 - RNA, 20 nt, Artificial Sequence
  synthesized
cuguugcuaggaagucaaau

SEQ ID NO: 898 - RNA, 20 nt, Artificial Sequence
  synthesized
guugcuaggaagucaaauuu

SEQ ID NO: 899 - RNA, 20 nt, Artificial Sequence
  synthesized
gagagaguaaguuguccaag

SEQ ID NO: 900 - RNA, 20 nt, Artificial Sequence
  synthesized
gagaguaaguuguccaaggc

SEQ ID NO: 901 - RNA, 20 nt, Artificial Sequence
  synthesized
ugguuggucaagugcaguag

SEQ ID NO: 902 - RNA, 20 nt, Artificial Sequence
  synthesized
gguggucccuucucagaggc

SEQ ID NO: 903 - RNA, 20 nt, Artificial Sequence
  synthesized
uggucccuucucagaggccc

SEQ ID NO: 904 - RNA, 20 nt, Artificial Sequence
  synthesized
cggagggugggcuccuggcc

SEQ ID NO: 905 - RNA, 20 nt, Artificial Sequence
  synthesized
gcgaggccaggagcccaccc

SEQ ID NO: 906 - RNA, 20 nt, Artificial Sequence
  synthesized
agcgagaacagcacuggaua

SEQ ID NO: 907 - RNA, 20 nt, Artificial Sequence
  synthesized
ccagccuccccacuaucaac

SEQ ID NO: 908 - RNA, 20 nt, Artificial Sequence
  synthesized
aggcccuuuggcuuacaccc

SEQ ID NO: 909 - RNA, 20 nt, Artificial Sequence
  synthesized
cuaggcccuuuggcuuacac

SEQ ID NO: 910 - RNA, 20 nt, Artificial Sequence
  synthesized
guccacacuuugaaguuggg

SEQ ID NO: 911 - RNA, 20 nt, Artificial Sequence
  synthesized
uagaacuuggcacuucaaag

SEQ ID NO: 912 - RNA, 20 nt, Artificial Sequence
  synthesized
cccccugcuggucccagaaa

SEQ ID NO: 913 - RNA, 20 nt, Artificial Sequence
  synthesized
cccugcuggucccagaaauc

SEQ ID NO: 914 - RNA, 20 nt, Artificial Sequence
  synthesized
agagucugaguuaaauguuu

SEQ ID NO: 915 - RNA, 20 nt, Artificial Sequence
  synthesized
cugugaaagcuagacugaac

SEQ ID NO: 916 - RNA, 20 nt, Artificial Sequence
  synthesized
gugaaagcuagacugaacca

SEQ ID NO: 917 - RNA, 20 nt, Artificial Sequence
  synthesized
agauaaaggcagugacucag

SEQ ID NO: 918 - RNA, 20 nt, Artificial Sequence
  synthesized
auaaaggcagugacucagcc

SEQ ID NO: 919 - RNA, 20 nt, Artificial Sequence
  synthesized
cagcugucccugaguguauc

SEQ ID NO: 920 - RNA, 20 nt, Artificial Sequence
  synthesized
gcugucccugaguguaucac

SEQ ID NO: 921 - RNA, 20 nt, Artificial Sequence
  synthesized
cagucccacuccuacccagg

SEQ ID NO: 922 - RNA, 20 nt, Artificial Sequence
  synthesized
cuggcccuaacuuuuuuuaa

SEQ ID NO: 923 - RNA, 20 nt, Artificial Sequence
  synthesized
ggcuggcccuaacuuuuuuu

SEQ ID NO: 924 - RNA, 20 nt, Artificial Sequence
  synthesized
uuuacuagggcaccaaggua

SEQ ID NO: 925 - RNA, 20 nt, Artificial Sequence
  synthesized
uuuuuacuagggcaccaagg

SEQ ID NO: 926 - RNA, 20 nt, Artificial Sequence
  synthesized
cacauuuuccccagcccagg

SEQ ID NO: 927 - RNA, 20 nt, Artificial Sequence
  synthesized
cauuuuccccagcccagggc

SEQ ID NO: 928 - RNA, 20 nt, Artificial Sequence
  synthesized
agaacugagccuaaucugau

SEQ ID NO: 929 - RNA, 20 nt, Artificial Sequence
  synthesized
ccagaacugagccuaaucug

SEQ ID NO: 930 - RNA, 20 nt, Artificial Sequence
  synthesized
cuaugaauacguacaggcag

SEQ ID NO: 931 - RNA, 20 nt, Artificial Sequence
  synthesized
ugacuaugaauacguacagg

SEQ ID NO: 932 - RNA, 20 nt, Artificial Sequence
  synthesized
agcuccguggucugcacuga

SEQ ID NO: 933 - RNA, 20 nt, Artificial Sequence
  synthesized
cuccguggucugcacugauc

SEQ ID NO: 934 - RNA, 20 nt, Artificial Sequence
  synthesized
ggggaagccugguucacugg

SEQ ID NO: 935 - RNA, 20 nt, Artificial Sequence
  synthesized
augccuacgacuggauuagu

SEQ ID NO: 936 - RNA, 20 nt, Artificial Sequence
  synthesized
gccuacgacuggauuaguau

SEQ ID NO: 937 - RNA, 20 nt, Artificial Sequence
  synthesized
aaacaggcaggaaacaggca

SEQ ID NO: 938 - RNA, 20 nt, Artificial Sequence
  synthesized
acaggcaggaaacaggcaga

SEQ ID NO: 939 - RNA, 20 nt, Artificial Sequence
  synthesized
cuacuugaaauuauacagga

SEQ ID NO: 940 - RNA, 20 nt, Artificial Sequence
  synthesized
auuuuuauugagcgccuucu

SEQ ID NO: 941 - RNA, 20 nt, Artificial Sequence
  synthesized
uggaagcuccucuuguguuc

SEQ ID NO: 942 - RNA, 20 nt, Artificial Sequence
  synthesized
ucuugcaggccacuggggca

SEQ ID NO: 943 - RNA, 20 nt, Artificial Sequence
  synthesized
uugcaggccacuggggcacc

SEQ ID NO: 944 - RNA, 20 nt, Artificial Sequence
  synthesized
uuuuaugcuugaaauucucc

SEQ ID NO: 945 - RNA, 20 nt, Artificial Sequence
  synthesized
aacagcauaaguauggaagg

SEQ ID NO: 946 - RNA, 20 nt, Artificial Sequence
  synthesized
uuaacagcauaaguauggaa

SEQ ID NO: 947 - RNA, 20 nt, Artificial Sequence
  synthesized
uuugguauuugaaaugaagg

SEQ ID NO: 948 - RNA, 20 nt, Artificial Sequence
  synthesized
aaaucaaaaaaugaucuggg

SEQ ID NO: 949 - RNA, 20 nt, Artificial Sequence
  synthesized
caugcccagaucauuuuuug

SEQ ID NO: 950 - RNA, 20 nt, Artificial Sequence
  synthesized
cccagaucauuuuuugauuu

SEQ ID NO: 951 - RNA, 20 nt, Artificial Sequence
  synthesized
ugcccagaucauuuuuugau

SEQ ID NO: 952 - RNA, 20 nt, Artificial Sequence
  synthesized
acggcaaaauugagcagaag

SEQ ID NO: 953 - RNA, 20 nt, Artificial Sequence
  synthesized
auuuugccgugaaccuaaaa

SEQ ID NO: 954 - RNA, 20 nt, Artificial Sequence
  synthesized
cuucugcucaauuuugccgu

SEQ ID NO: 955 - RNA, 20 nt, Artificial Sequence
  synthesized
gaguaguuuuagguucacgg

SEQ ID NO: 956 - RNA, 20 nt, Artificial Sequence
  synthesized
guaguuuuagguucacggca

SEQ ID NO: 957 - RNA, 20 nt, Artificial Sequence
  synthesized
ugcucaauuuugccgugaac

SEQ ID NO: 958 - RNA, 20 nt, Artificial Sequence
  synthesized
uuagguucacggcaaaauug

SEQ ID NO: 959 - RNA, 20 nt, Artificial Sequence
  synthesized
uuugccgugaaccuaaaacu

SEQ ID NO: 960 - RNA, 20 nt, Artificial Sequence
  synthesized
aaacuccacaguuuuccucc

SEQ ID NO: 961 - RNA, 20 nt, Artificial Sequence
  synthesized
aaacuccacgguuuuccucc

SEQ ID NO: 962 - RNA, 20 nt, Artificial Sequence
  synthesized
aagugaggaggaaaaccgug

SEQ ID NO: 963 - RNA, 20 nt, Artificial Sequence
  synthesized
aagugaggaggaaaacugug

SEQ ID NO: 964 - RNA, 20 nt, Artificial Sequence
  synthesized
acuccacaguuuuccuccuc

SEQ ID NO: 965 - RNA, 20 nt, Artificial Sequence
  synthesized
acuccacgguuuuccuccuc

SEQ ID NO: 966 - RNA, 20 nt, Artificial Sequence
  synthesized
aggaaaaccguggaguuuaa

SEQ ID NO: 967 - RNA, 20 nt, Artificial Sequence
  synthesized
aggaaaacuguggaguuuaa

SEQ ID NO: 968 - RNA, 20 nt, Artificial Sequence
  synthesized
cacaguuuuccuccucacuu

SEQ ID NO: 969 - RNA, 20 nt, Artificial Sequence
  synthesized
cacgguuuuccuccucacuu

SEQ ID NO: 970 - RNA, 20 nt, Artificial Sequence
  synthesized
cagguuaaacuccacaguuu

SEQ ID NO: 971 - RNA, 20 nt, Artificial Sequence
  synthesized
cagguuaaacuccacgguuu

SEQ ID NO: 972 - RNA, 20 nt, Artificial Sequence
  synthesized
caguuuuccuccucacuuga

SEQ ID NO: 973 - RNA, 20 nt, Artificial Sequence
  synthesized
ccgucagguuaaacuccaca

SEQ ID NO: 974 - RNA, 20 nt, Artificial Sequence
  synthesized
ccgucagguuaaacuccacg

SEQ ID NO: 975 - RNA, 20 nt, Artificial Sequence
  synthesized
cgguuuuccuccucacuuga

SEQ ID NO: 976 - RNA, 20 nt, Artificial Sequence
  synthesized
cguggaguuuaaccugacgg

SEQ ID NO: 977 - RNA, 20 nt, Artificial Sequence
  synthesized
gaggaggaaaaccguggagu

SEQ ID NO: 978 - RNA, 20 nt, Artificial Sequence
  synthesized
gaggaggaaaacuguggagu

SEQ ID NO: 979 - RNA, 20 nt, Artificial Sequence
  synthesized
ggaggaaaaccguggaguuu

SEQ ID NO: 980 - RNA, 20 nt, Artificial Sequence
  synthesized
ggaggaaaacuguggaguuu

SEQ ID NO: 981 - RNA, 20 nt, Artificial Sequence
  synthesized
gguuaaacuccacaguuuuc

SEQ ID NO: 982 - RNA, 20 nt, Artificial Sequence
  synthesized
gguuaaacuccacgguuuuc

SEQ ID NO: 983 - RNA, 20 nt, Artificial Sequence
  synthesized
gucagguuaaacuccacagu

SEQ ID NO: 984 - RNA, 20 nt, Artificial Sequence
  synthesized
gucagguuaaacuccacggu

SEQ ID NO: 985 - RNA, 20 nt, Artificial Sequence
  synthesized
gugaggaggaaaaccgugga

SEQ ID NO: 986 - RNA, 20 nt, Artificial Sequence
  synthesized
gugaggaggaaaacugugga

SEQ ID NO: 987 - RNA, 20 nt, Artificial Sequence
  synthesized
uccacaguuuuccuccucac

SEQ ID NO: 988 - RNA, 20 nt, Artificial Sequence
  synthesized
uccacgguuuuccuccucac

SEQ ID NO: 989 - RNA, 20 nt, Artificial Sequence
  synthesized
uguggaguuuaaccugacgg

SEQ ID NO: 990 - RNA, 20 nt, Artificial Sequence
  synthesized
uuaaacuccacaguuuuccu

SEQ ID NO: 991 - RNA, 20 nt, Artificial Sequence
  synthesized
uuaaacuccacgguuuuccu

SEQ ID NO: 992 - RNA, 20 nt, Artificial Sequence
  synthesized
acacuucagccugagugaca

SEQ ID NO: 993 - RNA, 20 nt, Artificial Sequence
  synthesized
ccugaggagcugggugggac

SEQ ID NO: 994 - RNA, 20 nt, Artificial Sequence
  synthesized
ccugaggagcugggugggau

SEQ ID NO: 995 - RNA, 20 nt, Artificial Sequence
  synthesized
ccuguaaucccacccagcuc

SEQ ID NO: 996 - RNA, 20 nt, Artificial Sequence
  synthesized
ccuguagucccacccagcuc

SEQ ID NO: 997 - RNA, 20 nt, Artificial Sequence
  synthesized
cuuaugccuguaaucccacc

SEQ ID NO: 998 - RNA, 20 nt, Artificial Sequence
  synthesized
cuuaugccuguagucccacc

SEQ ID NO: 999 - RNA, 20 nt, Artificial Sequence
  synthesized
gcugggugggacuacaggca

SEQ ID NO: 1000 - RNA, 20 nt, Artificial Sequence
  synthesized
gcugggugggauuacaggca

SEQ ID NO: 1001 - RNA, 20 nt, Artificial Sequence
  synthesized
ugaggagcugggugggacua

SEQ ID NO: 1002 - RNA, 20 nt, Artificial Sequence
  synthesized
ugaggagcugggugggauua

SEQ ID NO: 1003 - RNA, 20 nt, Artificial Sequence
  synthesized
uguaaucccacccagcuccu

SEQ ID NO: 1004 - RNA, 20 nt, Artificial Sequence
  synthesized
uguagucccacccagcuccu

SEQ ID NO: 1005 - RNA, 20 nt, Artificial Sequence
  synthesized
accagaucccaagccgucac

SEQ ID NO: 1006 - RNA, 20 nt, Artificial Sequence
  synthesized
accaguucccaagccgucac

SEQ ID NO: 1007 - RNA, 20 nt, Artificial Sequence
  synthesized
acuggugagguacuaggguc

SEQ ID NO: 1008 - RNA, 20 nt, Artificial Sequence
  synthesized
aguaccucaccagaucccaa

SEQ ID NO: 1009 - RNA, 20 nt, Artificial Sequence
  synthesized
aguaccucaccaguucccaa

SEQ ID NO: 1010 - RNA, 20 nt, Artificial Sequence
  synthesized
cagaucccaagccgucaccc

SEQ ID NO: 1011 - RNA, 20 nt, Artificial Sequence
  synthesized
caguucccaagccgucaccc

SEQ ID NO: 1012 - RNA, 20 nt, Artificial Sequence
  synthesized
ccucaccagaucccaagccg

SEQ ID NO: 1013 - RNA, 20 nt, Artificial Sequence
  synthesized
ccucaccaguucccaagccg

SEQ ID NO: 1014 - RNA, 20 nt, Artificial Sequence
  synthesized
cggcuugggaacuggugagg

SEQ ID NO: 1015 - RNA, 20 nt, Artificial Sequence
  synthesized
cggcuugggaucuggugagg

SEQ ID NO: 1016 - RNA, 20 nt, Artificial Sequence
  synthesized
cuaguaccucaccagauccc

SEQ ID NO: 1017 - RNA, 20 nt, Artificial Sequence
  synthesized
cuaguaccucaccaguuccc

SEQ ID NO: 1018 - RNA, 20 nt, Artificial Sequence
  synthesized
gaacuggugagguacuaggg

SEQ ID NO: 1019 - RNA, 20 nt, Artificial Sequence
  synthesized
gacccuaguaccucaccaga

SEQ ID NO: 1020 - RNA, 20 nt, Artificial Sequence
  synthesized
gacccuaguaccucaccagu

SEQ ID NO: 1021 - RNA, 20 nt, Artificial Sequence
  synthesized
gacggcuugggaacugguga

SEQ ID NO: 1022 - RNA, 20 nt, Artificial Sequence
  synthesized
gacggcuugggaucugguga

SEQ ID NO: 1023 - RNA, 20 nt, Artificial Sequence
  synthesized
gaucccaagccgucacccuu

SEQ ID NO: 1024 - RNA, 20 nt, Artificial Sequence
  synthesized
gaucuggugagguacuaggg

SEQ ID NO: 1025 - RNA, 20 nt, Artificial Sequence
  synthesized
gcuugggaacuggugaggua

SEQ ID NO: 1026 - RNA, 20 nt, Artificial Sequence
  synthesized
gcuugggaucuggugaggua

SEQ ID NO: 1027 - RNA, 20 nt, Artificial Sequence
  synthesized
gggaacuggugagguacuag

SEQ ID NO: 1028 - RNA, 20 nt, Artificial Sequence
  synthesized
gggaucuggugagguacuag

SEQ ID NO: 1029 - RNA, 20 nt, Artificial Sequence
  synthesized
gggugacggcuugggaacug

SEQ ID NO: 1030 - RNA, 20 nt, Artificial Sequence
  synthesized
gggugacggcuugggaucug

SEQ ID NO: 1031 - RNA, 20 nt, Artificial Sequence
  synthesized
gugacggcuugggaacuggu

SEQ ID NO: 1032 - RNA, 20 nt, Artificial Sequence
  synthesized
gugacggcuugggaucuggu

SEQ ID NO: 1033 - RNA, 20 nt, Artificial Sequence
  synthesized
guucccaagccgucacccuu

SEQ ID NO: 1034 - RNA, 20 nt, Artificial Sequence
  synthesized
ucaccagaucccaagccguc

SEQ ID NO: 1035 - RNA, 20 nt, Artificial Sequence
  synthesized
ucaccaguucccaagccguc

SEQ ID NO: 1036 - RNA, 20 nt, Artificial Sequence
  synthesized
ucuggugagguacuaggguc

SEQ ID NO: 1037 - RNA, 20 nt, Artificial Sequence
  synthesized
acacuuacgugacuuagggg

SEQ ID NO: 1038 - RNA, 20 nt, Artificial Sequence
  synthesized
acacuuaugugacuuagggg

SEQ ID NO: 1039 - RNA, 20 nt, Artificial Sequence
  synthesized
acagagccccuaagucacau

SEQ ID NO: 1040 - RNA, 20 nt, Artificial Sequence
  synthesized
acagagccccuaagucacgu

SEQ ID NO: 1041 - RNA, 20 nt, Artificial Sequence
  synthesized
acauaagugugcaagucaga

SEQ ID NO: 1042 - RNA, 20 nt, Artificial Sequence
  synthesized
acguaagugugcaagucaga

SEQ ID NO: 1043 - RNA, 20 nt, Artificial Sequence
  synthesized
acgugacuuaggggcucugu

SEQ ID NO: 1044 - RNA, 20 nt, Artificial Sequence
  synthesized
acuuacgugacuuaggggcu

SEQ ID NO: 1045 - RNA, 20 nt, Artificial Sequence
  synthesized
acuuaugugacuuaggggcu

SEQ ID NO: 1046 - RNA, 20 nt, Artificial Sequence
  synthesized
acuugcacacuuacgugacu

SEQ ID NO: 1047 - RNA, 20 nt, Artificial Sequence
  synthesized
acuugcacacuuaugugacu

SEQ ID NO: 1048 - RNA, 20 nt, Artificial Sequence
  synthesized
agagccccuaagucacauaa

SEQ ID NO: 1049 - RNA, 20 nt, Artificial Sequence
  synthesized
agagccccuaagucacguaa

SEQ ID NO: 1050 - RNA, 20 nt, Artificial Sequence
  synthesized
agccccuaagucacauaagu

SEQ ID NO: 1051 - RNA, 20 nt, Artificial Sequence
  synthesized
agccccuaagucacguaagu

SEQ ID NO: 1052 - RNA, 20 nt, Artificial Sequence
  synthesized
auaagugugcaagucagaac

SEQ ID NO: 1053 - RNA, 20 nt, Artificial Sequence
  synthesized
augugacuuaggggcucugu

SEQ ID NO: 1054 - RNA, 20 nt, Artificial Sequence
  synthesized
ccuaagucacauaagugugc

SEQ ID NO: 1055 - RNA, 20 nt, Artificial Sequence
  synthesized
ccuaagucacguaagugugc

SEQ ID NO: 1056 - RNA, 20 nt, Artificial Sequence
  synthesized
gcacacuuacgugacuuagg

SEQ ID NO: 1057 - RNA, 20 nt, Artificial Sequence
  synthesized
gcacacuuaugugacuuagg

SEQ ID NO: 1058 - RNA, 20 nt, Artificial Sequence
  synthesized
guaagugugcaagucagaac

SEQ ID NO: 1059 - RNA, 20 nt, Artificial Sequence
  synthesized
guucugacuugcacacuuac

SEQ ID NO: 1060 - RNA, 20 nt, Artificial Sequence
  synthesized
guucugacuugcacacuuau

SEQ ID NO: 1061 - RNA, 20 nt, Artificial Sequence
  synthesized
uaagucacauaagugugcaa

SEQ ID NO: 1062 - RNA, 20 nt, Artificial Sequence
  synthesized
uaagucacguaagugugcaa

SEQ ID NO: 1063 - RNA, 20 nt, Artificial Sequence
  synthesized
ucacauaagugugcaaguca

SEQ ID NO: 1064 - RNA, 20 nt, Artificial Sequence
  synthesized
ucacguaagugugcaaguca

SEQ ID NO: 1065 - RNA, 20 nt, Artificial Sequence
  synthesized
ucugacuugcacacuuacgu

SEQ ID NO: 1066 - RNA, 20 nt, Artificial Sequence
  synthesized
ucugacuugcacacuuaugu

SEQ ID NO: 1067 - RNA, 20 nt, Artificial Sequence
  synthesized
ugacuugcacacuuacguga

SEQ ID NO: 1068 - RNA, 20 nt, Artificial Sequence
  synthesized
ugacuugcacacuuauguga

SEQ ID NO: 1069 - RNA, 20 nt, Artificial Sequence
  synthesized
aaaccuacccggcgucacca

SEQ ID NO: 1070 - RNA, 20 nt, Artificial Sequence
  synthesized
aaaccuacccggggucacca

SEQ ID NO: 1071 - RNA, 20 nt, Artificial Sequence
  synthesized
accuacccggcgucaccaca

SEQ ID NO: 1072 - RNA, 20 nt, Artificial Sequence
  synthesized
accuacccggggucaccaca

SEQ ID NO: 1073 - RNA, 20 nt, Artificial Sequence
  synthesized
ccccggguagguuucagcuc

SEQ ID NO: 1074 - RNA, 20 nt, Artificial Sequence
  synthesized
ccuguguguggugaccccgg

SEQ ID NO: 1075 - RNA, 20 nt, Artificial Sequence
  synthesized
ccuguguguggugacgccgg

SEQ ID NO: 1076 - RNA, 20 nt, Artificial Sequence
  synthesized
cgccggguagguuucagcuc

SEQ ID NO: 1077 - RNA, 20 nt, Artificial Sequence
  synthesized
cgucaccacacacagguggc

SEQ ID NO: 1078 - RNA, 20 nt, Artificial Sequence
  synthesized
cuacccggcgucaccacaca

SEQ ID NO: 1079 - RNA, 20 nt, Artificial Sequence
  synthesized
cuacccggggucaccacaca

SEQ ID NO: 1080 - RNA, 20 nt, Artificial Sequence
  synthesized
gaccccggguagguuucagc

SEQ ID NO: 1081 - RNA, 20 nt, Artificial Sequence
  synthesized
gacgccggguagguuucagc

SEQ ID NO: 1082 - RNA, 20 nt, Artificial Sequence
  synthesized
gagcugaaaccuacccggcg

SEQ ID NO: 1083 - RNA, 20 nt, Artificial Sequence
  synthesized
gagcugaaaccuacccgggg

SEQ ID NO: 1084 - RNA, 20 nt, Artificial Sequence
  synthesized
gcugaaaccuacccggcguc

SEQ ID NO: 1085 - RNA, 20 nt, Artificial Sequence
  synthesized
gcugaaaccuacccgggguc

SEQ ID NO: 1086 - RNA, 20 nt, Artificial Sequence
  synthesized
ggcgucaccacacacaggug

SEQ ID NO: 1087 - RNA, 20 nt, Artificial Sequence
  synthesized
ggggucaccacacacaggug

SEQ ID NO: 1088 - RNA, 20 nt, Artificial Sequence
  synthesized
ggucaccacacacagguggc

SEQ ID NO: 1089 - RNA, 20 nt, Artificial Sequence
  synthesized
gugaccccggguagguuuca

SEQ ID NO: 1090 - RNA, 20 nt, Artificial Sequence
  synthesized
gugacgccggguagguuuca

SEQ ID NO: 1091 - RNA, 20 nt, Artificial Sequence
  synthesized
ugaaaccuacccggcgucac

SEQ ID NO: 1092 - RNA, 20 nt, Artificial Sequence
  synthesized
ugaaaccuacccggggucac

SEQ ID NO: 1093 - RNA, 20 nt, Artificial Sequence
  synthesized
uggugaccccggguagguuu

SEQ ID NO: 1094 - RNA, 20 nt, Artificial Sequence
  synthesized
uggugacgccggguagguuu

SEQ ID NO: 1095 - RNA, 20 nt, Artificial Sequence
  synthesized
uguggugaccccggguaggu

SEQ ID NO: 1096 - RNA, 20 nt, Artificial Sequence
  synthesized
uguggugacgccggguaggu

SEQ ID NO: 1097 - RNA, 20 nt, Artificial Sequence
  synthesized
uguguggugaccccggguag

SEQ ID NO: 1098 - RNA, 20 nt, Artificial Sequence
  synthesized
uguguggugacgccggguag

SEQ ID NO: 1099 - RNA, 20 nt, Artificial Sequence
  synthesized
aaaggaguccuugucuuagu

SEQ ID NO: 1100 - RNA, 20 nt, Artificial Sequence
  synthesized
aaaggaguccuugucuuggu

SEQ ID NO: 1101 - RNA, 20 nt, Artificial Sequence
  synthesized
aagaagggaccaagacaagg

SEQ ID NO: 1102 - RNA, 20 nt, Artificial Sequence
  synthesized
aagaagggacuaagacaagg

SEQ ID NO: 1103 - RNA, 20 nt, Artificial Sequence
  synthesized
acaaaggaguccuugucuua

SEQ ID NO: 1104 - RNA, 20 nt, Artificial Sequence
  synthesized
acaaaggaguccuugucuug

SEQ ID NO: 1105 - RNA, 20 nt, Artificial Sequence
  synthesized
accaagacaaggacuccuuu

SEQ ID NO: 1106 - RNA, 20 nt, Artificial Sequence
  synthesized
acuaagacaaggacuccuuu

SEQ ID NO: 1107 - RNA, 20 nt, Artificial Sequence
  synthesized
aggaguccuugucuuagucc

SEQ ID NO: 1108 - RNA, 20 nt, Artificial Sequence
  synthesized
aggaguccuugucuuggucc

SEQ ID NO: 1109 - RNA, 20 nt, Artificial Sequence
  synthesized
agggaccaagacaaggacuc

SEQ ID NO: 1110 - RNA, 20 nt, Artificial Sequence
  synthesized
agggacuaagacaaggacuc

SEQ ID NO: 1111 - RNA, 20 nt, Artificial Sequence
  synthesized
ccuugucuuagucccuucuu

SEQ ID NO: 1112 - RNA, 20 nt, Artificial Sequence
  synthesized
ccuugucuuggucccuucuu

SEQ ID NO: 1113 - RNA, 20 nt, Artificial Sequence
  synthesized
cuuagucccuucuuguaauc

SEQ ID NO: 1114 - RNA, 20 nt, Artificial Sequence
  synthesized
cuuggucccuucuuguaauc

SEQ ID NO: 1115 - RNA, 20 nt, Artificial Sequence
  synthesized
gaagggaccaagacaaggac

SEQ ID NO: 1116 - RNA, 20 nt, Artificial Sequence
  synthesized
gaagggacuaagacaaggac

SEQ ID NO: 1117 - RNA, 20 nt, Artificial Sequence
  synthesized
gaguccuugucuuagucccu

SEQ ID NO: 1118 - RNA, 20 nt, Artificial Sequence
  synthesized
gaguccuugucuuggucccu

SEQ ID NO: 1119 - RNA, 20 nt, Artificial Sequence
  synthesized
gauuacaagaagggaccaag

SEQ ID NO: 1120 - RNA, 20 nt, Artificial Sequence
  synthesized
gauuacaagaagggacuaag

SEQ ID NO: 1121 - RNA, 20 nt, Artificial Sequence
  synthesized
ggaccaagacaaggacuccu

SEQ ID NO: 1122 - RNA, 20 nt, Artificial Sequence
  synthesized
ggacuaagacaaggacuccu

SEQ ID NO: 1123 - RNA, 20 nt, Artificial Sequence
  synthesized
guccuugucuuagucccuuc

SEQ ID NO: 1124 - RNA, 20 nt, Artificial Sequence
  synthesized
guccuugucuuggucccuuc

SEQ ID NO: 1125 - RNA, 20 nt, Artificial Sequence
  synthesized
gucuuagucccuucuuguaa

SEQ ID NO: 1126 - RNA, 20 nt, Artificial Sequence
  synthesized
gucuuggucccuucuuguaa

SEQ ID NO: 1127 - RNA, 20 nt, Artificial Sequence
  synthesized
uagucccuucuuguaaucug

SEQ ID NO: 1128 - RNA, 20 nt, Artificial Sequence
  synthesized
uggucccuucuuguaaucug

SEQ ID NO: 1129 - RNA, 20 nt, Artificial Sequence
  synthesized
uuacaagaagggaccaagac

SEQ ID NO: 1130 - RNA, 20 nt, Artificial Sequence
  synthesized
uuacaagaagggacuaagac

SEQ ID NO: 1131 - RNA, 20 nt, Artificial Sequence
  synthesized
uugucuuagucccuucuugu

SEQ ID NO: 1132 - RNA, 20 nt, Artificial Sequence
  synthesized
uugucuuggucccuucuugu

SEQ ID NO: 1133 - RNA, 20 nt, Artificial Sequence
  synthesized
acaaaugcccugagguggga

SEQ ID NO: 1134 - RNA, 20 nt, Artificial Sequence
  synthesized
accugugugucuguacaaau

SEQ ID NO: 1135 - RNA, 20 nt, Artificial Sequence
  synthesized
accugugugucugugcaaau

SEQ ID NO: 1136 - RNA, 20 nt, Artificial Sequence
  synthesized
cagggcauuugcacagacac

SEQ ID NO: 1137 - RNA, 20 nt, Artificial Sequence
  synthesized
cagggcauuuguacagacac

SEQ ID NO: 1138 - RNA, 20 nt, Artificial Sequence
  synthesized
cucagggcauuugcacagac

SEQ ID NO: 1139 - RNA, 20 nt, Artificial Sequence
  synthesized
cucagggcauuuguacagac

SEQ ID NO: 1140 - RNA, 20 nt, Artificial Sequence
  synthesized
cugugugucuguacaaaugc

SEQ ID NO: 1141 - RNA, 20 nt, Artificial Sequence
  synthesized
cugugugucugugcaaaugc

SEQ ID NO: 1142 - RNA, 20 nt, Artificial Sequence
  synthesized
gcaccugugugucuguacaa

SEQ ID NO: 1143 - RNA, 20 nt, Artificial Sequence
  synthesized
gcaccugugugucugugcaa

SEQ ID NO: 1144 - RNA, 20 nt, Artificial Sequence
  synthesized
gcauuugcacagacacacag

SEQ ID NO: 1145 - RNA, 20 nt, Artificial Sequence
  synthesized
gcauuuguacagacacacag

SEQ ID NO: 1146 - RNA, 20 nt, Artificial Sequence
  synthesized
gggcaccugugugucuguac

SEQ ID NO: 1147 - RNA, 20 nt, Artificial Sequence
  synthesized
gggcaccugugugucugugc

SEQ ID NO: 1148 - RNA, 20 nt, Artificial Sequence
  synthesized
guacaaaugcccugaggugg

SEQ ID NO: 1149 - RNA, 20 nt, Artificial Sequence
  synthesized
gucuguacaaaugcccugag

SEQ ID NO: 1150 - RNA, 20 nt, Artificial Sequence
  synthesized
gucugugcaaaugcccugag

SEQ ID NO: 1151 - RNA, 20 nt, Artificial Sequence
  synthesized
aagaacucgccauauagcag

SEQ ID NO: 1152 - RNA, 20 nt, Artificial Sequence
  synthesized
aagauuaagaacucgccaua

SEQ ID NO: 1153 - RNA, 20 nt, Artificial Sequence
  synthesized
aagauuaggaacucgccaua

SEQ ID NO: 1154 - RNA, 20 nt, Artificial Sequence
  synthesized
agagcaggaagauuaagaac

SEQ ID NO: 1155 - RNA, 20 nt, Artificial Sequence
  synthesized
agagcaggaagauuaggaac

SEQ ID NO: 1156 - RNA, 20 nt, Artificial Sequence
  synthesized
agcaggaagauuaagaacuc

SEQ ID NO: 1157 - RNA, 20 nt, Artificial Sequence
  synthesized
agcaggaagauuaggaacuc

SEQ ID NO: 1158 - RNA, 20 nt, Artificial Sequence
  synthesized
aggaacucgccauauagcag

SEQ ID NO: 1159 - RNA, 20 nt, Artificial Sequence
  synthesized
caggaagauuaagaacucgc

SEQ ID NO: 1160 - RNA, 20 nt, Artificial Sequence
  synthesized
caggaagauuaggaacucgc

SEQ ID NO: 1161 - RNA, 20 nt, Artificial Sequence
  synthesized
cugcuauauggcgaguuccu

SEQ ID NO: 1162 - RNA, 20 nt, Artificial Sequence
  synthesized
cugcuauauggcgaguucuu

SEQ ID NO: 1163 - RNA, 20 nt, Artificial Sequence
  synthesized
gaguuccuaaucuuccugcu

SEQ ID NO: 1164 - RNA, 20 nt, Artificial Sequence
  synthesized
gaguucuuaaucuuccugcu

SEQ ID NO: 1165 - RNA, 20 nt, Artificial Sequence
  synthesized
gauuaagaacucgccauaua

SEQ ID NO: 1166 - RNA, 20 nt, Artificial Sequence
  synthesized
gauuaggaacucgccauaua

SEQ ID NO: 1167 - RNA, 20 nt, Artificial Sequence
  synthesized
gcgaguuccuaaucuuccug

SEQ ID NO: 1168 - RNA, 20 nt, Artificial Sequence
  synthesized
gcgaguucuuaaucuuccug

SEQ ID NO: 1169 - RNA, 20 nt, Artificial Sequence
  synthesized
gcuauauggcgaguuccuaa

SEQ ID NO: 1170 - RNA, 20 nt, Artificial Sequence
  synthesized
gcuauauggcgaguucuuaa

SEQ ID NO: 1171 - RNA, 20 nt, Artificial Sequence
  synthesized
guuccuaaucuuccugcucu

SEQ ID NO: 1172 - RNA, 20 nt, Artificial Sequence
  synthesized
guucuuaaucuuccugcucu

SEQ ID NO: 1173 - RNA, 20 nt, Artificial Sequence
  synthesized
uagcagagcaggaagauuaa

SEQ ID NO: 1174 - RNA, 20 nt, Artificial Sequence
  synthesized
uagcagagcaggaagauuag

SEQ ID NO: 1175 - RNA, 20 nt, Artificial Sequence
  synthesized
uauauggcgaguuccuaauc

SEQ ID NO: 1176 - RNA, 20 nt, Artificial Sequence
  synthesized
uauauggcgaguucuuaauc

SEQ ID NO: 1177 - RNA, 20 nt, Artificial Sequence
  synthesized
uauggcgaguuccuaaucuu

SEQ ID NO: 1178 - RNA, 20 nt, Artificial Sequence
  synthesized
uauggcgaguucuuaaucuu

SEQ ID NO: 1179 - RNA, 20 nt, Artificial Sequence
  synthesized
uccuaaucuuccugcucugc

SEQ ID NO: 1180 - RNA, 20 nt, Artificial Sequence
  synthesized
ucuuaaucuuccugcucugc

SEQ ID NO: 1181 - RNA, 20 nt, Artificial Sequence
  synthesized
uggcgaguuccuaaucuucc

SEQ ID NO: 1182 - RNA, 20 nt, Artificial Sequence
  synthesized
uggcgaguucuuaaucuucc

SEQ ID NO: 1183 - RNA, 20 nt, Artificial Sequence
  synthesized
uuaagaacucgccauauagc

SEQ ID NO: 1184 - RNA, 20 nt, Artificial Sequence
  synthesized
uuaggaacucgccauauagc

SEQ ID NO: 1185 - RNA, 20 nt, Artificial Sequence
  synthesized
aaggcagugggugggagaac

SEQ ID NO: 1186 - RNA, 20 nt, Artificial Sequence
  synthesized
aaggcggugggugggagaac

SEQ ID NO: 1187 - RNA, 20 nt, Artificial Sequence
  synthesized
acccaccgccuucuucacuc

SEQ ID NO: 1188 - RNA, 20 nt, Artificial Sequence
  synthesized
acccacugccuucuucacuc

SEQ ID NO: 1189 - RNA, 20 nt, Artificial Sequence
  synthesized
accgccuucuucacuccacu

SEQ ID NO: 1190 - RNA, 20 nt, Artificial Sequence
  synthesized
acugccuucuucacuccacu

SEQ ID NO: 1191 - RNA, 20 nt, Artificial Sequence
  synthesized
agaaggcagugggugggaga

SEQ ID NO: 1192 - RNA, 20 nt, Artificial Sequence
  synthesized
agaaggcggugggugggaga

SEQ ID NO: 1193 - RNA, 20 nt, Artificial Sequence
  synthesized
agaguggagugaagaaggca

SEQ ID NO: 1194 - RNA, 20 nt, Artificial Sequence
  synthesized
agaguggagugaagaaggcg

SEQ ID NO: 1195 - RNA, 20 nt, Artificial Sequence
  synthesized
agguucucccacccaccgcc

SEQ ID NO: 1196 - RNA, 20 nt, Artificial Sequence
  synthesized
agguucucccacccacugcc

SEQ ID NO: 1197 - RNA, 20 nt, Artificial Sequence
  synthesized
ccacccaccgccuucuucac

SEQ ID NO: 1198 - RNA, 20 nt, Artificial Sequence
  synthesized
ccacccacugccuucuucac

SEQ ID NO: 1199 - RNA, 20 nt, Artificial Sequence
  synthesized
ccaccgccuucuucacucca

SEQ ID NO: 1200 - RNA, 20 nt, Artificial Sequence
  synthesized
ccacugccuucuucacucca

SEQ ID NO: 1201 - RNA, 20 nt, Artificial Sequence
  synthesized
cgccuucuucacuccacucu

SEQ ID NO: 1202 - RNA, 20 nt, Artificial Sequence
  synthesized
gaagaaggcaguggguggga

SEQ ID NO: 1203 - RNA, 20 nt, Artificial Sequence
  synthesized
gaagaaggcgguggguggga

SEQ ID NO: 1204 - RNA, 20 nt, Artificial Sequence
  synthesized
gcagguucucccacccaccg

SEQ ID NO: 1205 - RNA, 20 nt, Artificial Sequence
  synthesized
gcagguucucccacccacug

SEQ ID NO: 1206 - RNA, 20 nt, Artificial Sequence
  synthesized
ggcagugggugggagaaccu

SEQ ID NO: 1207 - RNA, 20 nt, Artificial Sequence
  synthesized
ggcggugggugggagaaccu

SEQ ID NO: 1208 - RNA, 20 nt, Artificial Sequence
  synthesized
guucucccacccaccgccuu

SEQ ID NO: 1209 - RNA, 20 nt, Artificial Sequence
  synthesized
guucucccacccacugccuu

SEQ ID NO: 1210 - RNA, 20 nt, Artificial Sequence
  synthesized
ucccacccaccgccuucuuc

SEQ ID NO: 1211 - RNA, 20 nt, Artificial Sequence
  synthesized
ucccacccacugccuucuuc

SEQ ID NO: 1212 - RNA, 20 nt, Artificial Sequence
  synthesized
ucucccacccaccgccuucu

SEQ ID NO: 1213 - RNA, 20 nt, Artificial Sequence
  synthesized
ucucccacccacugccuucu

SEQ ID NO: 1214 - RNA, 20 nt, Artificial Sequence
  synthesized
ugccuucuucacuccacucu

SEQ ID NO: 1215 - RNA, 20 nt, Artificial Sequence
  synthesized
uggagugaagaaggcagugg

SEQ ID NO: 1216 - RNA, 20 nt, Artificial Sequence
  synthesized
uggagugaagaaggcggugg

SEQ ID NO: 1217 - RNA, 20 nt, Artificial Sequence
  synthesized
aaaaacacuauuucgcaaug

SEQ ID NO: 1218 - RNA, 20 nt, Artificial Sequence
  synthesized
aaaaacuauuucgcaaugac

SEQ ID NO: 1219 - RNA, 20 nt, Artificial Sequence
  synthesized
aaacacuauuucgcaaugac

SEQ ID NO: 1220 - RNA, 20 nt, Artificial Sequence
  synthesized
aggucauugcgaaauagugu

SEQ ID NO: 1221 - RNA, 20 nt, Artificial Sequence
  synthesized
aggucauugcgaaauaguuu

SEQ ID NO: 1222 - RNA, 20 nt, Artificial Sequence
  synthesized
aucugccuagaaaaaaaaac

SEQ ID NO: 1223 - RNA, 20 nt, Artificial Sequence
  synthesized
cauugcgaaauaguguuuuu

SEQ ID NO: 1224 - RNA, 20 nt, Artificial Sequence
  synthesized
cugccuagaaaaaaaaaaac

SEQ ID NO: 1225 - RNA, 20 nt, Artificial Sequence
  synthesized
cugccuagaaaaaaaaacac

SEQ ID NO: 1226 - RNA, 20 nt, Artificial Sequence
  synthesized
gucauugcgaaauaguguuu

SEQ ID NO: 1227 - RNA, 20 nt, Artificial Sequence
  synthesized
gucauugcgaaauaguuuuu

SEQ ID NO: 1228 - RNA, 20 nt, Artificial Sequence
  synthesized
guguuuuuuuuucuaggcag

SEQ ID NO: 1229 - RNA, 20 nt, Artificial Sequence
  synthesized
guuuuuuuuucuaggcagau

SEQ ID NO: 1230 - RNA, 20 nt, Artificial Sequence
  synthesized
guuuuuuuuuuucuaggcag

SEQ ID NO: 1231 - RNA, 20 nt, Artificial Sequence
  synthesized
aagaucaggaucucccuaug

SEQ ID NO: 1232 - RNA, 20 nt, Artificial Sequence
  synthesized
acaagaucaggaucucccua

SEQ ID NO: 1233 - RNA, 20 nt, Artificial Sequence
  synthesized
acaggaucaggaucucccua

SEQ ID NO: 1234 - RNA, 20 nt, Artificial Sequence
  synthesized
agacaagaucaggaucuccc

SEQ ID NO: 1235 - RNA, 20 nt, Artificial Sequence
  synthesized
agacaggaucaggaucuccc

SEQ ID NO: 1236 - RNA, 20 nt, Artificial Sequence
  synthesized
agagacaagaucaggaucuc

SEQ ID NO: 1237 - RNA, 20 nt, Artificial Sequence
  synthesized
agagacaggaucaggaucuc

SEQ ID NO: 1238 - RNA, 20 nt, Artificial Sequence
  synthesized
auagagacaagaucaggauc

SEQ ID NO: 1239 - RNA, 20 nt, Artificial Sequence
  synthesized
auagagacaggaucaggauc

SEQ ID NO: 1240 - RNA, 20 nt, Artificial Sequence
  synthesized
cauagggagauccugauccu

SEQ ID NO: 1241 - RNA, 20 nt, Artificial Sequence
  synthesized
cauagggagauccugaucuu

SEQ ID NO: 1242 - RNA, 20 nt, Artificial Sequence
  synthesized
cugauccugucucuauaaaa

SEQ ID NO: 1243 - RNA, 20 nt, Artificial Sequence
  synthesized
cugaucuugucucuauaaaa

SEQ ID NO: 1244 - RNA, 20 nt, Artificial Sequence
  synthesized
gagauccugauccugucucu

SEQ ID NO: 1245 - RNA, 20 nt, Artificial Sequence
  synthesized
gagauccugaucuugucucu

SEQ ID NO: 1246 - RNA, 20 nt, Artificial Sequence
  synthesized
gauccugauccugucucuau

SEQ ID NO: 1247 - RNA, 20 nt, Artificial Sequence
  synthesized
gauccugaucuugucucuau

SEQ ID NO: 1248 - RNA, 20 nt, Artificial Sequence
  synthesized
gggagauccugauccugucu

SEQ ID NO: 1249 - RNA, 20 nt, Artificial Sequence
  synthesized
gggagauccugaucuugucu

SEQ ID NO: 1250 - RNA, 20 nt, Artificial Sequence
  synthesized
uagggagauccugauccugu

SEQ ID NO: 1251 - RNA, 20 nt, Artificial Sequence
  synthesized
uagggagauccugaucuugu

SEQ ID NO: 1252 - RNA, 20 nt, Artificial Sequence
  synthesized
uccugauccugucucuauaa

SEQ ID NO: 1253 - RNA, 20 nt, Artificial Sequence
  synthesized
uccugaucuugucucuauaa

SEQ ID NO: 1254 - RNA, 20 nt, Artificial Sequence
  synthesized
uuauagagacaagaucagga

SEQ ID NO: 1255 - RNA, 20 nt, Artificial Sequence
  synthesized
uuauagagacaggaucagga

SEQ ID NO: 1256 - RNA, 20 nt, Artificial Sequence
  synthesized
uuuuauagagacaagaucag

SEQ ID NO: 1257 - RNA, 20 nt, Artificial Sequence
  synthesized
uuuuauagagacaggaucag

SEQ ID NO: 1258 - RNA, 20 nt, Artificial Sequence
  synthesized
accucaggcucucggaagac

SEQ ID NO: 1259 - RNA, 20 nt, Artificial Sequence
  synthesized
accuccggcucucggaagac

SEQ ID NO: 1260 - RNA, 20 nt, Artificial Sequence
  synthesized
agccggaggugggguugcag

SEQ ID NO: 1261 - RNA, 20 nt, Artificial Sequence
  synthesized
agccugaggugggguugcag

SEQ ID NO: 1262 - RNA, 20 nt, Artificial Sequence
  synthesized
ccaccucaggcucucggaag

SEQ ID NO: 1263 - RNA, 20 nt, Artificial Sequence
  synthesized
ccaccuccggcucucggaag

SEQ ID NO: 1264 - RNA, 20 nt, Artificial Sequence
  synthesized
ccggaggugggguugcagaa

SEQ ID NO: 1265 - RNA, 20 nt, Artificial Sequence
  synthesized
ccugaggugggguugcagaa

SEQ ID NO: 1266 - RNA, 20 nt, Artificial Sequence
  synthesized
cgagagccggaggugggguu

SEQ ID NO: 1267 - RNA, 20 nt, Artificial Sequence
  synthesized
cgagagccugaggugggguu

SEQ ID NO: 1268 - RNA, 20 nt, Artificial Sequence
  synthesized
cucaggcucucggaagaccc

SEQ ID NO: 1269 - RNA, 20 nt, Artificial Sequence
  synthesized
cuccggcucucggaagaccc

SEQ ID NO: 1270 - RNA, 20 nt, Artificial Sequence
  synthesized
cugcaaccccaccucaggcu

SEQ ID NO: 1271 - RNA, 20 nt, Artificial Sequence
  synthesized
cugcaaccccaccuccggcu

SEQ ID NO: 1272 - RNA, 20 nt, Artificial Sequence
  synthesized
cuuccgagagccggaggugg

SEQ ID NO: 1273 - RNA, 20 nt, Artificial Sequence
  synthesized
cuuccgagagccugaggugg

SEQ ID NO: 1274 - RNA, 20 nt, Artificial Sequence
  synthesized
gauucugcaaccccaccuca

SEQ ID NO: 1275 - RNA, 20 nt, Artificial Sequence
  synthesized
gauucugcaaccccaccucc

SEQ ID NO: 1276 - RNA, 20 nt, Artificial Sequence
  synthesized
ggaggugggguugcagaauc

SEQ ID NO: 1277 - RNA, 20 nt, Artificial Sequence
  synthesized
gggucuuccgagagccggag

SEQ ID NO: 1278 - RNA, 20 nt, Artificial Sequence
  synthesized
gggucuuccgagagccugag

SEQ ID NO: 1279 - RNA, 20 nt, Artificial Sequence
  synthesized
uccgagagccggaggugggg

SEQ ID NO: 1280 - RNA, 20 nt, Artificial Sequence
  synthesized
uccgagagccugaggugggg

SEQ ID NO: 1281 - RNA, 20 nt, Artificial Sequence
  synthesized
ugaggugggguugcagaauc

SEQ ID NO: 1282 - RNA, 20 nt, Artificial Sequence
  synthesized
uucugcaaccccaccucagg

SEQ ID NO: 1283 - RNA, 20 nt, Artificial Sequence
  synthesized
uucugcaaccccaccuccgg

SEQ ID NO: 1284 - RNA, 20 nt, Artificial Sequence
  synthesized
acaccccucagccccacucc

SEQ ID NO: 1285 - RNA, 20 nt, Artificial Sequence
  synthesized
acagacaccccucagcccca

SEQ ID NO: 1286 - RNA, 20 nt, Artificial Sequence
  synthesized
acagacgccccucagcccca

SEQ ID NO: 1287 - RNA, 20 nt, Artificial Sequence
  synthesized
accccucagccccacuccca

SEQ ID NO: 1288 - RNA, 20 nt, Artificial Sequence
  synthesized
acgccccucagccccacucc

SEQ ID NO: 1289 - RNA, 20 nt, Artificial Sequence
  synthesized
agacaccccucagccccacu

SEQ ID NO: 1290 - RNA, 20 nt, Artificial Sequence
  synthesized
agacgccccucagccccacu

SEQ ID NO: 1291 - RNA, 20 nt, Artificial Sequence
  synthesized
aggggcgucuguggggcacu

SEQ ID NO: 1292 - RNA, 20 nt, Artificial Sequence
  synthesized
aggggugucuguggggcacu

SEQ ID NO: 1293 - RNA, 20 nt, Artificial Sequence
  synthesized
agugccccacagacaccccu

SEQ ID NO: 1294 - RNA, 20 nt, Artificial Sequence
  synthesized
agugccccacagacgccccu

SEQ ID NO: 1295 - RNA, 20 nt, Artificial Sequence
  synthesized
aguggggcugaggggcgucu

SEQ ID NO: 1296 - RNA, 20 nt, Artificial Sequence
  synthesized
aguggggcugaggggugucu

SEQ ID NO: 1297 - RNA, 20 nt, Artificial Sequence
  synthesized
ccacagacaccccucagccc

SEQ ID NO: 1298 - RNA, 20 nt, Artificial Sequence
  synthesized
ccacagacgccccucagccc

SEQ ID NO: 1299 - RNA, 20 nt, Artificial Sequence
  synthesized
ccccacagacaccccucagc

SEQ ID NO: 1300 - RNA, 20 nt, Artificial Sequence
  synthesized
ccccacagacgccccucagc

SEQ ID NO: 1301 - RNA, 20 nt, Artificial Sequence
  synthesized
cuacagugccccacagacac

SEQ ID NO: 1302 - RNA, 20 nt, Artificial Sequence
  synthesized
cuacagugccccacagacgc

SEQ ID NO: 1303 - RNA, 20 nt, Artificial Sequence
  synthesized
gccccucagccccacuccca

SEQ ID NO: 1304 - RNA, 20 nt, Artificial Sequence
  synthesized
gcgucuguggggcacuguag

SEQ ID NO: 1305 - RNA, 20 nt, Artificial Sequence
  synthesized
gcugaggggcgucugugggg

SEQ ID NO: 1306 - RNA, 20 nt, Artificial Sequence
  synthesized
gcugaggggugucugugggg

SEQ ID NO: 1307 - RNA, 20 nt, Artificial Sequence
  synthesized
ggaguggggcugaggggcgu

SEQ ID NO: 1308 - RNA, 20 nt, Artificial Sequence
  synthesized
ggaguggggcugaggggugu

SEQ ID NO: 1309 - RNA, 20 nt, Artificial Sequence
  synthesized
gggcugaggggcgucugugg

SEQ ID NO: 1310 - RNA, 20 nt, Artificial Sequence
  synthesized
gggcugaggggugucugugg

SEQ ID NO: 1311 - RNA, 20 nt, Artificial Sequence
  synthesized
gugucuguggggcacuguag

SEQ ID NO: 1312 - RNA, 20 nt, Artificial Sequence
  synthesized
ugaggggcgucuguggggca

SEQ ID NO: 1313 - RNA, 20 nt, Artificial Sequence
  synthesized
ugaggggugucuguggggca

SEQ ID NO: 1314 - RNA, 20 nt, Artificial Sequence
  synthesized
ugccccacagacaccccuca

SEQ ID NO: 1315 - RNA, 20 nt, Artificial Sequence
  synthesized
ugccccacagacgccccuca

SEQ ID NO: 1316 - RNA, 20 nt, Artificial Sequence
  synthesized
ugggaguggggcugaggggc

SEQ ID NO: 1317 - RNA, 20 nt, Artificial Sequence
  synthesized
ugggaguggggcugaggggu

SEQ ID NO: 1318 - RNA, 20 nt, Artificial Sequence
  synthesized
aaaaggagggggccuggcau

SEQ ID NO: 1319 - RNA, 20 nt, Artificial Sequence
  synthesized
aaaaggagggggcuuggcau

SEQ ID NO: 1320 - RNA, 20 nt, Artificial Sequence
  synthesized
aaagaaaaggagggggccug

SEQ ID NO: 1321 - RNA, 20 nt, Artificial Sequence
  synthesized
aaagaaaaggagggggcuug

SEQ ID NO: 1322 - RNA, 20 nt, Artificial Sequence
  synthesized
aaaggagggggcuuggcaua

SEQ ID NO: 1323 - RNA, 20 nt, Artificial Sequence
  synthesized
aagaaaaggagggggcuugg

SEQ ID NO: 1324 - RNA, 20 nt, Artificial Sequence
  synthesized
aagcccccuccuuuucuuuc

SEQ ID NO: 1325 - RNA, 20 nt, Artificial Sequence
  synthesized
agaaaaggagggggccuggc

SEQ ID NO: 1326 - RNA, 20 nt, Artificial Sequence
  synthesized
agaaaaggagggggcuuggc

SEQ ID NO: 1327 - RNA, 20 nt, Artificial Sequence
  synthesized
agcuaugccaagcccccucc

SEQ ID NO: 1328 - RNA, 20 nt, Artificial Sequence
  synthesized
agcuaugccaggcccccucc

SEQ ID NO: 1329 - RNA, 20 nt, Artificial Sequence
  synthesized
agggggccuggcauagcugg

SEQ ID NO: 1330 - RNA, 20 nt, Artificial Sequence
  synthesized
agggggcuuggcauagcugg

SEQ ID NO: 1331 - RNA, 20 nt, Artificial Sequence
  synthesized
augccaagcccccuccuuuu

SEQ ID NO: 1332 - RNA, 20 nt, Artificial Sequence
  synthesized
augccaggcccccuccuuuu

SEQ ID NO: 1333 - RNA, 20 nt, Artificial Sequence
  synthesized
cagcuaugccaagcccccuc

SEQ ID NO: 1334 - RNA, 20 nt, Artificial Sequence
  synthesized
ccaagcccccuccuuuucuu

SEQ ID NO: 1335 - RNA, 20 nt, Artificial Sequence
  synthesized
ccagcuaugccaagcccccu

SEQ ID NO: 1336 - RNA, 20 nt, Artificial Sequence
  synthesized
ccagcuaugccaggcccccu

SEQ ID NO: 1337 - RNA, 20 nt, Artificial Sequence
  synthesized
ccccuguccagcuaugccaa

SEQ ID NO: 1338 - RNA, 20 nt, Artificial Sequence
  synthesized
cccuguccagcuaugccaag

SEQ ID NO: 1339 - RNA, 20 nt, Artificial Sequence
  synthesized
cccuguccagcuaugccagg

SEQ ID NO: 1340 - RNA, 20 nt, Artificial Sequence
  synthesized
ccuggcauagcuggacaggg

SEQ ID NO: 1341 - RNA, 20 nt, Artificial Sequence
  synthesized
ccuguccagcuaugccaagc

SEQ ID NO: 1342 - RNA, 20 nt, Artificial Sequence
  synthesized
cuaugccaagcccccuccuu

SEQ ID NO: 1343 - RNA, 20 nt, Artificial Sequence
  synthesized
cuaugccaggcccccuccuu

SEQ ID NO: 1344 - RNA, 20 nt, Artificial Sequence
  synthesized
cuguccagcuaugccaagcc

SEQ ID NO: 1345 - RNA, 20 nt, Artificial Sequence
  synthesized
cuguccagcuaugccaggcc

SEQ ID NO: 1346 - RNA, 20 nt, Artificial Sequence
  synthesized
cuuggcauagcuggacaggg

SEQ ID NO: 1347 - RNA, 20 nt, Artificial Sequence
  synthesized
gaaaaggagggggcuuggca

SEQ ID NO: 1348 - RNA, 20 nt, Artificial Sequence
  synthesized
gaaagaaaaggagggggcuu

SEQ ID NO: 1349 - RNA, 20 nt, Artificial Sequence
  synthesized
gagggggcuuggcauagcug

SEQ ID NO: 1350 - RNA, 20 nt, Artificial Sequence
  synthesized
gccaagcccccuccuuuucu

SEQ ID NO: 1351 - RNA, 20 nt, Artificial Sequence
  synthesized
gccaggcccccuccuuuucu

SEQ ID NO: 1352 - RNA, 20 nt, Artificial Sequence
  synthesized
gcuaugccaagcccccuccu

SEQ ID NO: 1353 - RNA, 20 nt, Artificial Sequence
  synthesized
gggggcuuggcauagcugga

SEQ ID NO: 1354 - RNA, 20 nt, Artificial Sequence
  synthesized
guccagcuaugccaagcccc

SEQ ID NO: 1355 - RNA, 20 nt, Artificial Sequence
  synthesized
guccagcuaugccaggcccc

SEQ ID NO: 1356 - RNA, 20 nt, Artificial Sequence
  synthesized
uaugccaagcccccuccuuu

SEQ ID NO: 1357 - RNA, 20 nt, Artificial Sequence
  synthesized
uccagcuaugccaagccccc

SEQ ID NO: 1358 - RNA, 20 nt, Artificial Sequence
  synthesized
ugccaagcccccuccuuuuc

SEQ ID NO: 1359 - RNA, 20 nt, Artificial Sequence
  synthesized
uguccagcuaugccaagccc

SEQ ID NO: 1360 - RNA, 20 nt, Artificial Sequence
  synthesized
uuggcauagcuggacagggg

SEQ ID NO: 1361 - RNA, 20 nt, Artificial Sequence
  synthesized
aaaaaauacaaaucagcugg

SEQ ID NO: 1362 - RNA, 20 nt, Artificial Sequence
  synthesized
aaaauacaaaucagcugggc

SEQ ID NO: 1363 - RNA, 20 nt, Artificial Sequence
  synthesized
acaccacgacgcccagcuga

SEQ ID NO: 1364 - RNA, 20 nt, Artificial Sequence
  synthesized
acgcccagcugauuuguauu

SEQ ID NO: 1365 - RNA, 20 nt, Artificial Sequence
  synthesized
caaaucagcugggcgucgug

SEQ ID NO: 1366 - RNA, 20 nt, Artificial Sequence
  synthesized
cacgacgcccagcugauuug

SEQ ID NO: 1367 - RNA, 20 nt, Artificial Sequence
  synthesized
ccagcugauuuguauuuuuu

SEQ ID NO: 1368 - RNA, 20 nt, Artificial Sequence
  synthesized
ccagcugauuuuuguauuuu

SEQ ID NO: 1369 - RNA, 20 nt, Artificial Sequence
  synthesized
cgacgcccagcugauuugua

SEQ ID NO: 1370 - RNA, 20 nt, Artificial Sequence
  synthesized
gcccagcugauuuguauuuu

SEQ ID NO: 1371 - RNA, 20 nt, Artificial Sequence
  synthesized
accagacucaccccccucca

SEQ ID NO: 1372 - RNA, 20 nt, Artificial Sequence
  synthesized
accagacucaccccgcucca

SEQ ID NO: 1373 - RNA, 20 nt, Artificial Sequence
  synthesized
caccccccuccaccagcccc

SEQ ID NO: 1374 - RNA, 20 nt, Artificial Sequence
  synthesized
caccccgcuccaccagcccc

SEQ ID NO: 1375 - RNA, 20 nt, Artificial Sequence
  synthesized
cagacucaccccccuccacc

SEQ ID NO: 1376 - RNA, 20 nt, Artificial Sequence
  synthesized
cagacucaccccgcuccacc

SEQ ID NO: 1377 - RNA, 20 nt, Artificial Sequence
  synthesized
ccaccagacucaccccccuc

SEQ ID NO: 1378 - RNA, 20 nt, Artificial Sequence
  synthesized
ccaccagacucaccccgcuc

SEQ ID NO: 1379 - RNA, 20 nt, Artificial Sequence
  synthesized
ccccaccagacucacccccc

SEQ ID NO: 1380 - RNA, 20 nt, Artificial Sequence
  synthesized
ccccaccagacucaccccgc

SEQ ID NO: 1381 - RNA, 20 nt, Artificial Sequence
  synthesized
ccccccuccaccagccccgg

SEQ ID NO: 1382 - RNA, 20 nt, Artificial Sequence
  synthesized
ccccgcuccaccagccccgg

SEQ ID NO: 1383 - RNA, 20 nt, Artificial Sequence
  synthesized
ccccuccaccagccccggca

SEQ ID NO: 1384 - RNA, 20 nt, Artificial Sequence
  synthesized
ccgcuccaccagccccggca

SEQ ID NO: 1385 - RNA, 20 nt, Artificial Sequence
  synthesized
ccuccaccagccccggcagg

SEQ ID NO: 1386 - RNA, 20 nt, Artificial Sequence
  synthesized
cucaccccccuccaccagcc

SEQ ID NO: 1387 - RNA, 20 nt, Artificial Sequence
  synthesized
cucaccccgcuccaccagcc

SEQ ID NO: 1388 - RNA, 20 nt, Artificial Sequence
  synthesized
gacucaccccccuccaccag

SEQ ID NO: 1389 - RNA, 20 nt, Artificial Sequence
  synthesized
gacucaccccgcuccaccag

SEQ ID NO: 1390 - RNA, 20 nt, Artificial Sequence
  synthesized
gcuccaccagccccggcagg

SEQ ID NO: 1391 - RNA, 20 nt, Artificial Sequence
  synthesized
ggcugguggagcggggugag

SEQ ID NO: 1392 - RNA, 20 nt, Artificial Sequence
  synthesized
ggcugguggaggggggugag

SEQ ID NO: 1393 - RNA, 20 nt, Artificial Sequence
  synthesized
ggggcugguggagcggggug

SEQ ID NO: 1394 - RNA, 20 nt, Artificial Sequence
  synthesized
ggggcugguggaggggggug

SEQ ID NO: 1395 - RNA, 20 nt, Artificial Sequence
  synthesized
gguggagcggggugagucug

SEQ ID NO: 1396 - RNA, 20 nt, Artificial Sequence
  synthesized
gguggaggggggugagucug

SEQ ID NO: 1397 - RNA, 20 nt, Artificial Sequence
  synthesized
aaggccccaucacucucuga

SEQ ID NO: 1398 - RNA, 20 nt, Artificial Sequence
  synthesized
aaggccccaucgcucucuga

SEQ ID NO: 1399 - RNA, 20 nt, Artificial Sequence
  synthesized
agcgauggggccuugaugga

SEQ ID NO: 1400 - RNA, 20 nt, Artificial Sequence
  synthesized
agugauggggccuugaugga

SEQ ID NO: 1401 - RNA, 20 nt, Artificial Sequence
  synthesized
aucacucucugagagcaauu

SEQ ID NO: 1402 - RNA, 20 nt, Artificial Sequence
  synthesized
aucgcucucugagagcaauu

SEQ ID NO: 1403 - RNA, 20 nt, Artificial Sequence
  synthesized
cacucucugagagcaauuca

SEQ ID NO: 1404 - RNA, 20 nt, Artificial Sequence
  synthesized
caucaaggccccaucacucu

SEQ ID NO: 1405 - RNA, 20 nt, Artificial Sequence
  synthesized
caucaaggccccaucgcucu

SEQ ID NO: 1406 - RNA, 20 nt, Artificial Sequence
  synthesized
ccaucacucucugagagcaa

SEQ ID NO: 1407 - RNA, 20 nt, Artificial Sequence
  synthesized
ccaucgcucucugagagcaa

SEQ ID NO: 1408 - RNA, 20 nt, Artificial Sequence
  synthesized
ccccaucacucucugagagc

SEQ ID NO: 1409 - RNA, 20 nt, Artificial Sequence
  synthesized
ccccaucgcucucugagagc

SEQ ID NO: 1410 - RNA, 20 nt, Artificial Sequence
  synthesized
cgauggggccuugauggagc

SEQ ID NO: 1411 - RNA, 20 nt, Artificial Sequence
  synthesized
cgcucucugagagcaauuca

SEQ ID NO: 1412 - RNA, 20 nt, Artificial Sequence
  synthesized
gcuccaucaaggccccauca

SEQ ID NO: 1413 - RNA, 20 nt, Artificial Sequence
  synthesized
gcuccaucaaggccccaucg

SEQ ID NO: 1414 - RNA, 20 nt, Artificial Sequence
  synthesized
gcucucagagagcgaugggg

SEQ ID NO: 1415 - RNA, 20 nt, Artificial Sequence
  synthesized
gcucucagagagugaugggg

SEQ ID NO: 1416 - RNA, 20 nt, Artificial Sequence
  synthesized
ggccccaucacucucugaga

SEQ ID NO: 1417 - RNA, 20 nt, Artificial Sequence
  synthesized
ggccccaucgcucucugaga

SEQ ID NO: 1418 - RNA, 20 nt, Artificial Sequence
  synthesized
ucagagagcgauggggccuu

SEQ ID NO: 1419 - RNA, 20 nt, Artificial Sequence
  synthesized
ucagagagugauggggccuu

SEQ ID NO: 1420 - RNA, 20 nt, Artificial Sequence
  synthesized
uccaucaaggccccaucacu

SEQ ID NO: 1421 - RNA, 20 nt, Artificial Sequence
  synthesized
uccaucaaggccccaucgcu

SEQ ID NO: 1422 - RNA, 20 nt, Artificial Sequence
  synthesized
ucucagagagcgauggggcc

SEQ ID NO: 1423 - RNA, 20 nt, Artificial Sequence
  synthesized
ucucagagagugauggggcc

SEQ ID NO: 1424 - RNA, 20 nt, Artificial Sequence
  synthesized
ugaauugcucucagagagcg

SEQ ID NO: 1425 - RNA, 20 nt, Artificial Sequence
  synthesized
ugaauugcucucagagagug

SEQ ID NO: 1426 - RNA, 20 nt, Artificial Sequence
  synthesized
ugauggggccuugauggagc

SEQ ID NO: 1427 - RNA, 20 nt, Artificial Sequence
  synthesized
uugcucucagagagcgaugg

SEQ ID NO: 1428 - RNA, 20 nt, Artificial Sequence
  synthesized
uugcucucagagagugaugg

SEQ ID NO: 1429 - RNA, 20 nt, Artificial Sequence
  synthesized
aagcccuuccugccugacca

SEQ ID NO: 1430 - RNA, 20 nt, Artificial Sequence
  synthesized
aagggcgucauggggugugg

SEQ ID NO: 1431 - RNA, 20 nt, Artificial Sequence
  synthesized
aagggcuucauggggugugg

SEQ ID NO: 1432 - RNA, 20 nt, Artificial Sequence
  synthesized
acaccccaugaagcccuucc

SEQ ID NO: 1433 - RNA, 20 nt, Artificial Sequence
  synthesized
acaccccaugacgcccuucc

SEQ ID NO: 1434 - RNA, 20 nt, Artificial Sequence
  synthesized
acgcccuuccugccugacca

SEQ ID NO: 1435 - RNA, 20 nt, Artificial Sequence
  synthesized
auuuccacaccccaugaagc

SEQ ID NO: 1436 - RNA, 20 nt, Artificial Sequence
  synthesized
auuuccacaccccaugacgc

SEQ ID NO: 1437 - RNA, 20 nt, Artificial Sequence
  synthesized
caggaagggcgucauggggu

SEQ ID NO: 1438 - RNA, 20 nt, Artificial Sequence
  synthesized
caggaagggcuucauggggu

SEQ ID NO: 1439 - RNA, 20 nt, Artificial Sequence
  synthesized
caugaagcccuuccugccug

SEQ ID NO: 1440 - RNA, 20 nt, Artificial Sequence
  synthesized
caugacgcccuuccugccug

SEQ ID NO: 1441 - RNA, 20 nt, Artificial Sequence
  synthesized
ccacaccccaugaagcccuu

SEQ ID NO: 1442 - RNA, 20 nt, Artificial Sequence
  synthesized
ccacaccccaugacgcccuu

SEQ ID NO: 1443 - RNA, 20 nt, Artificial Sequence
  synthesized
cuauuuccacaccccaugaa

SEQ ID NO: 1444 - RNA, 20 nt, Artificial Sequence
  synthesized
cuauuuccacaccccaugac

SEQ ID NO: 1445 - RNA, 20 nt, Artificial Sequence
  synthesized
ggcaggaagggcgucauggg

SEQ ID NO: 1446 - RNA, 20 nt, Artificial Sequence
  synthesized
ggcaggaagggcuucauggg

SEQ ID NO: 1447 - RNA, 20 nt, Artificial Sequence
  synthesized
gggcgucaugggguguggaa

SEQ ID NO: 1448 - RNA, 20 nt, Artificial Sequence
  synthesized
gggcuucaugggguguggaa

SEQ ID NO: 1449 - RNA, 20 nt, Artificial Sequence
  synthesized
gucaugggguguggaaauag

SEQ ID NO: 1450 - RNA, 20 nt, Artificial Sequence
  synthesized
ugaagcccuuccugccugac

SEQ ID NO: 1451 - RNA, 20 nt, Artificial Sequence
  synthesized
ugacgcccuuccugccugac

SEQ ID NO: 1452 - RNA, 20 nt, Artificial Sequence
  synthesized
uggucaggcaggaagggcgu

SEQ ID NO: 1453 - RNA, 20 nt, Artificial Sequence
  synthesized
uggucaggcaggaagggcuu

SEQ ID NO: 1454 - RNA, 20 nt, Artificial Sequence
  synthesized
uucaugggguguggaaauag

SEQ ID NO: 1455 - RNA, 20 nt, Artificial Sequence
  synthesized
uuccacaccccaugaagccc

SEQ ID NO: 1456 - RNA, 20 nt, Artificial Sequence
  synthesized
uuccacaccccaugacgccc

SEQ ID NO: 1457 - RNA, 20 nt, Artificial Sequence
  synthesized
acaggcuguccuucgaguag

SEQ ID NO: 1458 - RNA, 20 nt, Artificial Sequence
  synthesized
acucgaaggacagccuauga

SEQ ID NO: 1459 - RNA, 20 nt, Artificial Sequence
  synthesized
acucgaaggacagccuguga

SEQ ID NO: 1460 - RNA, 20 nt, Artificial Sequence
  synthesized
aggacagccuaugaucagug

SEQ ID NO: 1461 - RNA, 20 nt, Artificial Sequence
  synthesized
aggacagccugugaucagug

SEQ ID NO: 1462 - RNA, 20 nt, Artificial Sequence
  synthesized
auaggcuguccuucgaguag

SEQ ID NO: 1463 - RNA, 20 nt, Artificial Sequence
  synthesized
aucacugaucacaggcuguc

SEQ ID NO: 1464 - RNA, 20 nt, Artificial Sequence
  synthesized
aucacugaucauaggcuguc

SEQ ID NO: 1465 - RNA, 20 nt, Artificial Sequence
  synthesized
augaucagugaugcagugga

SEQ ID NO: 1466 - RNA, 20 nt, Artificial Sequence
  synthesized
cacugcaucacugaucacag

SEQ ID NO: 1467 - RNA, 20 nt, Artificial Sequence
  synthesized
cacugcaucacugaucauag

SEQ ID NO: 1468 - RNA, 20 nt, Artificial Sequence
  synthesized
cuacucgaaggacagccuau

SEQ ID NO: 1469 - RNA, 20 nt, Artificial Sequence
  synthesized
cuacucgaaggacagccugu

SEQ ID NO: 1470 - RNA, 20 nt, Artificial Sequence
  synthesized
cuaugaucagugaugcagug

SEQ ID NO: 1471 - RNA, 20 nt, Artificial Sequence
  synthesized
cugaucacaggcuguccuuc

SEQ ID NO: 1472 - RNA, 20 nt, Artificial Sequence
  synthesized
cugaucauaggcuguccuuc

SEQ ID NO: 1473 - RNA, 20 nt, Artificial Sequence
  synthesized
cugcaucacugaucacaggc

SEQ ID NO: 1474 - RNA, 20 nt, Artificial Sequence
  synthesized
cugcaucacugaucauaggc

SEQ ID NO: 1475 - RNA, 20 nt, Artificial Sequence
  synthesized
cugugaucagugaugcagug

SEQ ID NO: 1476 - RNA, 20 nt, Artificial Sequence
  synthesized
gacagccuaugaucagugau

SEQ ID NO: 1477 - RNA, 20 nt, Artificial Sequence
  synthesized
gacagccugugaucagugau

SEQ ID NO: 1478 - RNA, 20 nt, Artificial Sequence
  synthesized
gaucacaggcuguccuucga

SEQ ID NO: 1479 - RNA, 20 nt, Artificial Sequence
  synthesized
gaucauaggcuguccuucga

SEQ ID NO: 1480 - RNA, 20 nt, Artificial Sequence
  synthesized
gcaucacugaucacaggcug

SEQ ID NO: 1481 - RNA, 20 nt, Artificial Sequence
  synthesized
gcaucacugaucauaggcug

SEQ ID NO: 1482 - RNA, 20 nt, Artificial Sequence
  synthesized
gugaucagugaugcagugga

SEQ ID NO: 1483 - RNA, 20 nt, Artificial Sequence
  synthesized
ucacaggcuguccuucgagu

SEQ ID NO: 1484 - RNA, 20 nt, Artificial Sequence
  synthesized
ucauaggcuguccuucgagu

SEQ ID NO: 1485 - RNA, 20 nt, Artificial Sequence
  synthesized
aacccaagccucaaacucug

SEQ ID NO: 1486 - RNA, 20 nt, Artificial Sequence
  synthesized
aacccaagucucaaacucug

SEQ ID NO: 1487 - RNA, 20 nt, Artificial Sequence
  synthesized
agcucaaacccaagccucaa

SEQ ID NO: 1488 - RNA, 20 nt, Artificial Sequence
  synthesized
agcucaaacccaagucucaa

SEQ ID NO: 1489 - RNA, 20 nt, Artificial Sequence
  synthesized
agggagcucaaacccaagcc

SEQ ID NO: 1490 - RNA, 20 nt, Artificial Sequence
  synthesized
agggagcucaaacccaaguc

SEQ ID NO: 1491 - RNA, 20 nt, Artificial Sequence
  synthesized
cccaagccucaaacucugga

SEQ ID NO: 1492 - RNA, 20 nt, Artificial Sequence
  synthesized
cccaagucucaaacucugga

SEQ ID NO: 1493 - RNA, 20 nt, Artificial Sequence
  synthesized
ccucaaacucuggauacaag

SEQ ID NO: 1494 - RNA, 20 nt, Artificial Sequence
  synthesized
cucaaacccaagccucaaac

SEQ ID NO: 1495 - RNA, 20 nt, Artificial Sequence
  synthesized
cucaaacccaagucucaaac

SEQ ID NO: 1496 - RNA, 20 nt, Artificial Sequence
  synthesized
cuuguauccagaguuugaga

SEQ ID NO: 1497 - RNA, 20 nt, Artificial Sequence
  synthesized
cuuguauccagaguuugagg

SEQ ID NO: 1498 - RNA, 20 nt, Artificial Sequence
  synthesized
gacuuggguuugagcucccu

SEQ ID NO: 1499 - RNA, 20 nt, Artificial Sequence
  synthesized
gaguuugagacuuggguuug

SEQ ID NO: 1500 - RNA, 20 nt, Artificial Sequence
  synthesized
gaguuugaggcuuggguuug

SEQ ID NO: 1501 - RNA, 20 nt, Artificial Sequence
  synthesized
ggagcucaaacccaagccuc

SEQ ID NO: 1502 - RNA, 20 nt, Artificial Sequence
  synthesized
ggagcucaaacccaagucuc

SEQ ID NO: 1503 - RNA, 20 nt, Artificial Sequence
  synthesized
ggcuuggguuugagcucccu

SEQ ID NO: 1504 - RNA, 20 nt, Artificial Sequence
  synthesized
guuugagacuuggguuugag

SEQ ID NO: 1505 - RNA, 20 nt, Artificial Sequence
  synthesized
guuugaggcuuggguuugag

SEQ ID NO: 1506 - RNA, 20 nt, Artificial Sequence
  synthesized
uauccagaguuugagacuug

SEQ ID NO: 1507 - RNA, 20 nt, Artificial Sequence
  synthesized
uauccagaguuugaggcuug

SEQ ID NO: 1508 - RNA, 20 nt, Artificial Sequence
  synthesized
uccagaguuugagacuuggg

SEQ ID NO: 1509 - RNA, 20 nt, Artificial Sequence
  synthesized
uccagaguuugaggcuuggg

SEQ ID NO: 1510 - RNA, 20 nt, Artificial Sequence
  synthesized
ucucaaacucuggauacaag

SEQ ID NO: 1511 - RNA, 20 nt, Artificial Sequence
  synthesized
uugagacuuggguuugagcu

SEQ ID NO: 1512 - RNA, 20 nt, Artificial Sequence
  synthesized
uugaggcuuggguuugagcu

SEQ ID NO: 1513 - RNA, 20 nt, Artificial Sequence
  synthesized
gaauuacuugaggucaggag

SEQ ID NO: 1514 - RNA, 20 nt, Artificial Sequence
  synthesized
cacuguacccggccaaccuc

SEQ ID NO: 1515 - RNA, 20 nt, Artificial Sequence
  synthesized
gagccacuguacccggccaa

SEQ ID NO: 1516 - RNA, 20 nt, Artificial Sequence
  synthesized
gagguuggccggguacagug

SEQ ID NO: 1517 - RNA, 20 nt, Artificial Sequence
  synthesized
gccacuguacccggccaacc

SEQ ID NO: 1518 - RNA, 20 nt, Artificial Sequence
  synthesized
guacccggccaaccucucuu

SEQ ID NO: 1519 - RNA, 20 nt, Artificial Sequence
  synthesized
aaagagagguuggccgggcg

SEQ ID NO: 1520 - RNA, 20 nt, Artificial Sequence
  synthesized
acugcgcccggccaaccucu

SEQ ID NO: 1521 - RNA, 20 nt, Artificial Sequence
  synthesized
agagagguuggccgggcgca

SEQ ID NO: 1522 - RNA, 20 nt, Artificial Sequence
  synthesized
agagguuggccgggcgcagu

SEQ ID NO: 1523 - RNA, 20 nt, Artificial Sequence
  synthesized
agccacugcgcccggccaac

SEQ ID NO: 1524 - RNA, 20 nt, Artificial Sequence
  synthesized
ccacugcgcccggccaaccu

SEQ ID NO: 1525 - RNA, 20 nt, Artificial Sequence
  synthesized
cgcccggccaaccucucuuu

SEQ ID NO: 1526 - RNA, 20 nt, Artificial Sequence
  synthesized
ugcgcccggccaaccucucu

SEQ ID NO: 1527 - RNA, 20 nt, Artificial Sequence
  synthesized
aaaaggucccgaacacuucc

SEQ ID NO: 1528 - RNA, 20 nt, Artificial Sequence
  synthesized
aaaaggucccggacacuucc

SEQ ID NO: 1529 - RNA, 20 nt, Artificial Sequence
  synthesized
aaguguccgggaccuuuucu

SEQ ID NO: 1530 - RNA, 20 nt, Artificial Sequence
  synthesized
aaguguucgggaccuuuucu

SEQ ID NO: 1531 - RNA, 20 nt, Artificial Sequence
  synthesized
agaaaaggucccgaacacuu

SEQ ID NO: 1532 - RNA, 20 nt, Artificial Sequence
  synthesized
agaaaaggucccggacacuu

SEQ ID NO: 1533 - RNA, 20 nt, Artificial Sequence
  synthesized
agggaaguguccgggaccuu

SEQ ID NO: 1534 - RNA, 20 nt, Artificial Sequence
  synthesized
agggaaguguucgggaccuu

SEQ ID NO: 1535 - RNA, 20 nt, Artificial Sequence
  synthesized
agugagaaaaggucccgaac

SEQ ID NO: 1536 - RNA, 20 nt, Artificial Sequence
  synthesized
agugagaaaaggucccggac

SEQ ID NO: 1537 - RNA, 20 nt, Artificial Sequence
  synthesized
ccgaacacuucccuaggauc

SEQ ID NO: 1538 - RNA, 20 nt, Artificial Sequence
  synthesized
ccggacacuucccuaggauc

SEQ ID NO: 1539 - RNA, 20 nt, Artificial Sequence
  synthesized
ccgggaccuuuucucacuuc

SEQ ID NO: 1540 - RNA, 20 nt, Artificial Sequence
  synthesized
cuagggaaguguccgggacc

SEQ ID NO: 1541 - RNA, 20 nt, Artificial Sequence
  synthesized
cuagggaaguguucgggacc

SEQ ID NO: 1542 - RNA, 20 nt, Artificial Sequence
  synthesized
gaagugagaaaaggucccga

SEQ ID NO: 1543 - RNA, 20 nt, Artificial Sequence
  synthesized
gaagugagaaaaggucccgg

SEQ ID NO: 1544 - RNA, 20 nt, Artificial Sequence
  synthesized
gauccuagggaaguguccgg

SEQ ID NO: 1545 - RNA, 20 nt, Artificial Sequence
  synthesized
gauccuagggaaguguucgg

SEQ ID NO: 1546 - RNA, 20 nt, Artificial Sequence
  synthesized
ggaaguguccgggaccuuuu

SEQ ID NO: 1547 - RNA, 20 nt, Artificial Sequence
  synthesized
ggaaguguucgggaccuuuu

SEQ ID NO: 1548 - RNA, 20 nt, Artificial Sequence
  synthesized
ggucccgaacacuucccuag

SEQ ID NO: 1549 - RNA, 20 nt, Artificial Sequence
  synthesized
ggucccggacacuucccuag

SEQ ID NO: 1550 - RNA, 20 nt, Artificial Sequence
  synthesized
guccgggaccuuuucucacu

SEQ ID NO: 1551 - RNA, 20 nt, Artificial Sequence
  synthesized
guucgggaccuuuucucacu

SEQ ID NO: 1552 - RNA, 20 nt, Artificial Sequence
  synthesized
ucccgaacacuucccuagga

SEQ ID NO: 1553 - RNA, 20 nt, Artificial Sequence
  synthesized
ucccggacacuucccuagga

SEQ ID NO: 1554 - RNA, 20 nt, Artificial Sequence
  synthesized
uccuagggaaguguccggga

SEQ ID NO: 1555 - RNA, 20 nt, Artificial Sequence
  synthesized
uccuagggaaguguucggga

SEQ ID NO: 1556 - RNA, 20 nt, Artificial Sequence
  synthesized
ucgggaccuuuucucacuuc

SEQ ID NO: 1557 - RNA, 20 nt, Artificial Sequence
  synthesized
ugagaaaaggucccgaacac

SEQ ID NO: 1558 - RNA, 20 nt, Artificial Sequence
  synthesized
ugagaaaaggucccggacac

SEQ ID NO: 1559 - RNA, 20 nt, Artificial Sequence
  synthesized
aggacaacacccccucuacc

SEQ ID NO: 1560 - RNA, 20 nt, Artificial Sequence
  synthesized
agggcaacacccccucuacc

SEQ ID NO: 1561 - RNA, 20 nt, Artificial Sequence
  synthesized
augguagaggggguguugcc

SEQ ID NO: 1562 - RNA, 20 nt, Artificial Sequence
  synthesized
augguagaggggguguuguc

SEQ ID NO: 1563 - RNA, 20 nt, Artificial Sequence
  synthesized
auuuaggacaacacccccuc

SEQ ID NO: 1564 - RNA, 20 nt, Artificial Sequence
  synthesized
auuuagggcaacacccccuc

SEQ ID NO: 1565 - RNA, 20 nt, Artificial Sequence
  synthesized
cagggcuggaauuuaggaca

SEQ ID NO: 1566 - RNA, 20 nt, Artificial Sequence
  synthesized
cagggcuggaauuuagggca

SEQ ID NO: 1567 - RNA, 20 nt, Artificial Sequence
  synthesized
gaauuuaggacaacaccccc

SEQ ID NO: 1568 - RNA, 20 nt, Artificial Sequence
  synthesized
gaauuuagggcaacaccccc

SEQ ID NO: 1569 - RNA, 20 nt, Artificial Sequence
  synthesized
gacaacacccccucuaccau

SEQ ID NO: 1570 - RNA, 20 nt, Artificial Sequence
  synthesized
gcuggaauuuaggacaacac

SEQ ID NO: 1571 - RNA, 20 nt, Artificial Sequence
  synthesized
gcuggaauuuagggcaacac

SEQ ID NO: 1572 - RNA, 20 nt, Artificial Sequence
  synthesized
ggcaacacccccucuaccau

SEQ ID NO: 1573 - RNA, 20 nt, Artificial Sequence
  synthesized
gggcuggaauuuaggacaac

SEQ ID NO: 1574 - RNA, 20 nt, Artificial Sequence
  synthesized
gggcuggaauuuagggcaac

SEQ ID NO: 1575 - RNA, 20 nt, Artificial Sequence
  synthesized
ggggguguugcccuaaauuc

SEQ ID NO: 1576 - RNA, 20 nt, Artificial Sequence
  synthesized
ggggguguuguccuaaauuc

SEQ ID NO: 1577 - RNA, 20 nt, Artificial Sequence
  synthesized
ggguguugcccuaaauucca

SEQ ID NO: 1578 - RNA, 20 nt, Artificial Sequence
  synthesized
ggguguuguccuaaauucca

SEQ ID NO: 1579 - RNA, 20 nt, Artificial Sequence
  synthesized
gguagaggggguguugcccu

SEQ ID NO: 1580 - RNA, 20 nt, Artificial Sequence
  synthesized
gguagaggggguguuguccu

SEQ ID NO: 1581 - RNA, 20 nt, Artificial Sequence
  synthesized
uagaggggguguugcccuaa

SEQ ID NO: 1582 - RNA, 20 nt, Artificial Sequence
  synthesized
uagaggggguguuguccuaa

SEQ ID NO: 1583 - RNA, 20 nt, Artificial Sequence
  synthesized
ugcccuaaauuccagcccug

SEQ ID NO: 1584 - RNA, 20 nt, Artificial Sequence
  synthesized
uggaauuuaggacaacaccc

SEQ ID NO: 1585 - RNA, 20 nt, Artificial Sequence
  synthesized
uggaauuuagggcaacaccc

SEQ ID NO: 1586 - RNA, 20 nt, Artificial Sequence
  synthesized
uguccuaaauuccagcccug

SEQ ID NO: 1587 - RNA, 20 nt, Artificial Sequence
  synthesized
uuaggacaacacccccucua

SEQ ID NO: 1588 - RNA, 20 nt, Artificial Sequence
  synthesized
uuagggcaacacccccucua

SEQ ID NO: 1589 - RNA, 20 nt, Artificial Sequence
  synthesized
acucagccucagacuacagg

SEQ ID NO: 1590 - RNA, 20 nt, Artificial Sequence
  synthesized
acucagccucagacugcagg

SEQ ID NO: 1591 - RNA, 20 nt, Artificial Sequence
  synthesized
auacucagccucagacuaca

SEQ ID NO: 1592 - RNA, 20 nt, Artificial Sequence
  synthesized
auacucagccucagacugca

SEQ ID NO: 1593 - RNA, 20 nt, Artificial Sequence
  synthesized
ccugcagucugaggcugagu

SEQ ID NO: 1594 - RNA, 20 nt, Artificial Sequence
  synthesized
ccuguagucugaggcugagu

SEQ ID NO: 1595 - RNA, 20 nt, Artificial Sequence
  synthesized
cgauacucagccucagacua

SEQ ID NO: 1596 - RNA, 20 nt, Artificial Sequence
  synthesized
cgauacucagccucagacug

SEQ ID NO: 1597 - RNA, 20 nt, Artificial Sequence
  synthesized
ggcgugugccugcagucuga

SEQ ID NO: 1598 - RNA, 20 nt, Artificial Sequence
  synthesized
ggcgugugccuguagucuga

SEQ ID NO: 1599 - RNA, 20 nt, Artificial Sequence
  synthesized
ucagccucagacuacaggca

SEQ ID NO: 1600 - RNA, 20 nt, Artificial Sequence
  synthesized
ucagccucagacugcaggca

SEQ ID NO: 1601 - RNA, 20 nt, Artificial Sequence
  synthesized
ugccugcagucugaggcuga

SEQ ID NO: 1602 - RNA, 20 nt, Artificial Sequence
  synthesized
ugccuguagucugaggcuga

SEQ ID NO: 1603 - RNA, 20 nt, Artificial Sequence
  synthesized
ugugccugcagucugaggcu

SEQ ID NO: 1604 - RNA, 20 nt, Artificial Sequence
  synthesized
ugugccuguagucugaggcu

SEQ ID NO: 1605 - RNA, 20 nt, Artificial Sequence
  synthesized
aaucuugucuugggaugggu

SEQ ID NO: 1606 - RNA, 20 nt, Artificial Sequence
  synthesized
aaucuugucuugggcugggu

SEQ ID NO: 1607 - RNA, 20 nt, Artificial Sequence
  synthesized
acacccagcccaagacaaga

SEQ ID NO: 1608 - RNA, 20 nt, Artificial Sequence
  synthesized
acacccaucccaagacaaga

SEQ ID NO: 1609 - RNA, 20 nt, Artificial Sequence
  synthesized
acccagcccaagacaagauu

SEQ ID NO: 1610 - RNA, 20 nt, Artificial Sequence
  synthesized
acccaucccaagacaagauu

SEQ ID NO: 1611 - RNA, 20 nt, Artificial Sequence
  synthesized
agaaucuugucuugggaugg

SEQ ID NO: 1612 - RNA, 20 nt, Artificial Sequence
  synthesized
agaaucuugucuugggcugg

SEQ ID NO: 1613 - RNA, 20 nt, Artificial Sequence
  synthesized
agcccaagacaagauucuua

SEQ ID NO: 1614 - RNA, 20 nt, Artificial Sequence
  synthesized
aucccaagacaagauucuua

SEQ ID NO: 1615 - RNA, 20 nt, Artificial Sequence
  synthesized
auggguguggaggcaagugg

SEQ ID NO: 1616 - RNA, 20 nt, Artificial Sequence
  synthesized
ccacacccagcccaagacaa

SEQ ID NO: 1617 - RNA, 20 nt, Artificial Sequence
  synthesized
ccacacccaucccaagacaa

SEQ ID NO: 1618 - RNA, 20 nt, Artificial Sequence
  synthesized
ccacuugccuccacacccag

SEQ ID NO: 1619 - RNA, 20 nt, Artificial Sequence
  synthesized
ccacuugccuccacacccau

SEQ ID NO: 1620 - RNA, 20 nt, Artificial Sequence
  synthesized
ccagcccaagacaagauucu

SEQ ID NO: 1621 - RNA, 20 nt, Artificial Sequence
  synthesized
ccaucccaagacaagauucu

SEQ ID NO: 1622 - RNA, 20 nt, Artificial Sequence
  synthesized
cuccacacccagcccaagac

SEQ ID NO: 1623 - RNA, 20 nt, Artificial Sequence
  synthesized
cuccacacccaucccaagac

SEQ ID NO: 1624 - RNA, 20 nt, Artificial Sequence
  synthesized
cuugggauggguguggaggc

SEQ ID NO: 1625 - RNA, 20 nt, Artificial Sequence
  synthesized
cuugggcuggguguggaggc

SEQ ID NO: 1626 - RNA, 20 nt, Artificial Sequence
  synthesized
gucuugggauggguguggag

SEQ ID NO: 1627 - RNA, 20 nt, Artificial Sequence
  synthesized
gucuugggcuggguguggag

SEQ ID NO: 1628 - RNA, 20 nt, Artificial Sequence
  synthesized
aauggggaugagcuggaugu

SEQ ID NO: 1629 - RNA, 20 nt, Artificial Sequence
  synthesized
aauggggaugagcuguaugu

SEQ ID NO: 1630 - RNA, 20 nt, Artificial Sequence
  synthesized
acagcuacauacagcucauc

SEQ ID NO: 1631 - RNA, 20 nt, Artificial Sequence
  synthesized
acagcuacauccagcucauc

SEQ ID NO: 1632 - RNA, 20 nt, Artificial Sequence
  synthesized
acagcucauccccauuuccu

SEQ ID NO: 1633 - RNA, 20 nt, Artificial Sequence
  synthesized
acauacagcucauccccauu

SEQ ID NO: 1634 - RNA, 20 nt, Artificial Sequence
  synthesized
agcuacauacagcucauccc

SEQ ID NO: 1635 - RNA, 20 nt, Artificial Sequence
  synthesized
agcuacauccagcucauccc

SEQ ID NO: 1636 - RNA, 20 nt, Artificial Sequence
  synthesized
agcuguauguagcugucgca

SEQ ID NO: 1637 - RNA, 20 nt, Artificial Sequence
  synthesized
aggaaauggggaugagcugu

SEQ ID NO: 1638 - RNA, 20 nt, Artificial Sequence
  synthesized
auacagcucauccccauuuc

SEQ ID NO: 1639 - RNA, 20 nt, Artificial Sequence
  synthesized
auccagcucauccccauuuc

SEQ ID NO: 1640 - RNA, 20 nt, Artificial Sequence
  synthesized
auugcgacagcuacauacag

SEQ ID NO: 1641 - RNA, 20 nt, Artificial Sequence
  synthesized
auugcgacagcuacauccag

SEQ ID NO: 1642 - RNA, 20 nt, Artificial Sequence
  synthesized
ccagcucauccccauuuccu

SEQ ID NO: 1643 - RNA, 20 nt, Artificial Sequence
  synthesized
cgacagcuacauacagcuca

SEQ ID NO: 1644 - RNA, 20 nt, Artificial Sequence
  synthesized
cgacagcuacauccagcuca

SEQ ID NO: 1645 - RNA, 20 nt, Artificial Sequence
  synthesized
cuacauacagcucaucccca

SEQ ID NO: 1646 - RNA, 20 nt, Artificial Sequence
  synthesized
cuacauccagcucaucccca

SEQ ID NO: 1647 - RNA, 20 nt, Artificial Sequence
  synthesized
cuguauguagcugucgcaau

SEQ ID NO: 1648 - RNA, 20 nt, Artificial Sequence
  synthesized
gaaauggggaugagcuggau

SEQ ID NO: 1649 - RNA, 20 nt, Artificial Sequence
  synthesized
gaaauggggaugagcuguau

SEQ ID NO: 1650 - RNA, 20 nt, Artificial Sequence
  synthesized
gggaugagcuggauguagcu

SEQ ID NO: 1651 - RNA, 20 nt, Artificial Sequence
  synthesized
gggaugagcuguauguagcu

SEQ ID NO: 1652 - RNA, 20 nt, Artificial Sequence
  synthesized
guauugcgacagcuacauac

SEQ ID NO: 1653 - RNA, 20 nt, Artificial Sequence
  synthesized
ugagcuggauguagcugucg

SEQ ID NO: 1654 - RNA, 20 nt, Artificial Sequence
  synthesized
ugagcuguauguagcugucg

SEQ ID NO: 1655 - RNA, 20 nt, Artificial Sequence
  synthesized
ugcgacagcuacauacagcu

SEQ ID NO: 1656 - RNA, 20 nt, Artificial Sequence
  synthesized
ugcgacagcuacauccagcu

SEQ ID NO: 1657 - RNA, 20 nt, Artificial Sequence
  synthesized
uggggaugagcuggauguag

SEQ ID NO: 1658 - RNA, 20 nt, Artificial Sequence
  synthesized
uggggaugagcuguauguag

SEQ ID NO: 1659 - RNA, 20 nt, Artificial Sequence
  synthesized
aaggagagguggugccgauc

SEQ ID NO: 1660 - RNA, 20 nt, Artificial Sequence
  synthesized
aaggagagguggugccgcuc

SEQ ID NO: 1661 - RNA, 20 nt, Artificial Sequence
  synthesized
aaggcagagcggcaccaccu

SEQ ID NO: 1662 - RNA, 20 nt, Artificial Sequence
  synthesized
aaggcagaucggcaccaccu

SEQ ID NO: 1663 - RNA, 20 nt, Artificial Sequence
  synthesized
agaaggcagagcggcaccac

SEQ ID NO: 1664 - RNA, 20 nt, Artificial Sequence
  synthesized
agaaggcagaucggcaccac

SEQ ID NO: 1665 - RNA, 20 nt, Artificial Sequence
  synthesized
agagguggugccgaucugcc

SEQ ID NO: 1666 - RNA, 20 nt, Artificial Sequence
  synthesized
agagguggugccgcucugcc

SEQ ID NO: 1667 - RNA, 20 nt, Artificial Sequence
  synthesized
agguggugccgaucugccuu

SEQ ID NO: 1668 - RNA, 20 nt, Artificial Sequence
  synthesized
agguggugccgcucugccuu

SEQ ID NO: 1669 - RNA, 20 nt, Artificial Sequence
  synthesized
auaaggagagguggugccga

SEQ ID NO: 1670 - RNA, 20 nt, Artificial Sequence
  synthesized
auaaggagagguggugccgc

SEQ ID NO: 1671 - RNA, 20 nt, Artificial Sequence
  synthesized
cagagcggcaccaccucucc

SEQ ID NO: 1672 - RNA, 20 nt, Artificial Sequence
  synthesized
cagaucggcaccaccucucc

SEQ ID NO: 1673 - RNA, 20 nt, Artificial Sequence
  synthesized
ccgaucugccuucuaaaggg

SEQ ID NO: 1674 - RNA, 20 nt, Artificial Sequence
  synthesized
ccgcucugccuucuaaaggg

SEQ ID NO: 1675 - RNA, 20 nt, Artificial Sequence
  synthesized
cuuuagaaggcagagcggca

SEQ ID NO: 1676 - RNA, 20 nt, Artificial Sequence
  synthesized
cuuuagaaggcagaucggca

SEQ ID NO: 1677 - RNA, 20 nt, Artificial Sequence
  synthesized
gagcggcaccaccucuccuu

SEQ ID NO: 1678 - RNA, 20 nt, Artificial Sequence
  synthesized
gaucggcaccaccucuccuu

SEQ ID NO: 1679 - RNA, 20 nt, Artificial Sequence
  synthesized
gcggcaccaccucuccuuau

SEQ ID NO: 1680 - RNA, 20 nt, Artificial Sequence
  synthesized
ggagagguggugccgaucug

SEQ ID NO: 1681 - RNA, 20 nt, Artificial Sequence
  synthesized
ggagagguggugccgcucug

SEQ ID NO: 1682 - RNA, 20 nt, Artificial Sequence
  synthesized
ggcagagcggcaccaccucu

SEQ ID NO: 1683 - RNA, 20 nt, Artificial Sequence
  synthesized
ggcagaucggcaccaccucu

SEQ ID NO: 1684 - RNA, 20 nt, Artificial Sequence
  synthesized
guggugccgaucugccuucu

SEQ ID NO: 1685 - RNA, 20 nt, Artificial Sequence
  synthesized
guggugccgcucugccuucu

SEQ ID NO: 1686 - RNA, 20 nt, Artificial Sequence
  synthesized
ucggcaccaccucuccuuau

SEQ ID NO: 1687 - RNA, 20 nt, Artificial Sequence
  synthesized
ugcccuuuagaaggcagagc

SEQ ID NO: 1688 - RNA, 20 nt, Artificial Sequence
  synthesized
ugccgcucugccuucuaaag

SEQ ID NO: 1689 - RNA, 20 nt, Artificial Sequence
  synthesized
uuagaaggcagagcggcacc

SEQ ID NO: 1690 - RNA, 20 nt, Artificial Sequence
  synthesized
uuagaaggcagaucggcacc

SEQ ID NO: 1691 - RNA, 20 nt, Artificial Sequence
  synthesized
aauagcuaaugcacgcaagg

SEQ ID NO: 1692 - RNA, 20 nt, Artificial Sequence
  synthesized
agccuugcgugcauuagcua

SEQ ID NO: 1693 - RNA, 20 nt, Artificial Sequence
  synthesized
caaauagcuaaugcacgcaa

SEQ ID NO: 1694 - RNA, 20 nt, Artificial Sequence
  synthesized
ccuugcgugcauuagcuauu

SEQ ID NO: 1695 - RNA, 20 nt, Artificial Sequence
  synthesized
gacaaauagcuaaugcacgc

SEQ ID NO: 1696 - RNA, 20 nt, Artificial Sequence
  synthesized
gcuaaugcacgcaaggcuua

SEQ ID NO: 1697 - RNA, 20 nt, Artificial Sequence
  synthesized
uaagccuugcgugcauuagc

SEQ ID NO: 1698 - RNA, 20 nt, Artificial Sequence
  synthesized
aacaacugacccuuggaugc

SEQ ID NO: 1699 - RNA, 20 nt, Artificial Sequence
  synthesized
aacaacugacccuuggcugc

SEQ ID NO: 1700 - RNA, 20 nt, Artificial Sequence
  synthesized
acccuuggaugcauucaaag

SEQ ID NO: 1701 - RNA, 20 nt, Artificial Sequence
  synthesized
acccuuggcugcauucaaag

SEQ ID NO: 1702 - RNA, 20 nt, Artificial Sequence
  synthesized
acugacccuuggaugcauuc

SEQ ID NO: 1703 - RNA, 20 nt, Artificial Sequence
  synthesized
acugacccuuggcugcauuc

SEQ ID NO: 1704 - RNA, 20 nt, Artificial Sequence
  synthesized
agccaagggucaguuguuua

SEQ ID NO: 1705 - RNA, 20 nt, Artificial Sequence
  synthesized
auccaagggucaguuguuua

SEQ ID NO: 1706 - RNA, 20 nt, Artificial Sequence
  synthesized
augcagccaagggucaguug

SEQ ID NO: 1707 - RNA, 20 nt, Artificial Sequence
  synthesized
augcauccaagggucaguug

SEQ ID NO: 1708 - RNA, 20 nt, Artificial Sequence
  synthesized
augcauucaaaggaucaggg

SEQ ID NO: 1709 - RNA, 20 nt, Artificial Sequence
  synthesized
caacugacccuuggaugcau

SEQ ID NO: 1710 - RNA, 20 nt, Artificial Sequence
  synthesized
caacugacccuuggcugcau

SEQ ID NO: 1711 - RNA, 20 nt, Artificial Sequence
  synthesized
cccugauccuuugaaugcag

SEQ ID NO: 1712 - RNA, 20 nt, Artificial Sequence
  synthesized
cccugauccuuugaaugcau

SEQ ID NO: 1713 - RNA, 20 nt, Artificial Sequence
  synthesized
ccuuggaugcauucaaagga

SEQ ID NO: 1714 - RNA, 20 nt, Artificial Sequence
  synthesized
ccuuggcugcauucaaagga

SEQ ID NO: 1715 - RNA, 20 nt, Artificial Sequence
  synthesized
cugcauucaaaggaucaggg

SEQ ID NO: 1716 - RNA, 20 nt, Artificial Sequence
  synthesized
cuuugaaugcagccaagggu

SEQ ID NO: 1717 - RNA, 20 nt, Artificial Sequence
  synthesized
cuuugaaugcauccaagggu

SEQ ID NO: 1718 - RNA, 20 nt, Artificial Sequence
  synthesized
gaaugcagccaagggucagu

SEQ ID NO: 1719 - RNA, 20 nt, Artificial Sequence
  synthesized
gaaugcauccaagggucagu

SEQ ID NO: 1720 - RNA, 20 nt, Artificial Sequence
  synthesized
gcagccaagggucaguuguu

SEQ ID NO: 1721 - RNA, 20 nt, Artificial Sequence
  synthesized
gcauccaagggucaguuguu

SEQ ID NO: 1722 - RNA, 20 nt, Artificial Sequence
  synthesized
uaaacaacugacccuuggau

SEQ ID NO: 1723 - RNA, 20 nt, Artificial Sequence
  synthesized
uaaacaacugacccuuggcu

SEQ ID NO: 1724 - RNA, 20 nt, Artificial Sequence
  synthesized
uccuuugaaugcagccaagg

SEQ ID NO: 1725 - RNA, 20 nt, Artificial Sequence
  synthesized
uccuuugaaugcauccaagg

SEQ ID NO: 1726 - RNA, 20 nt, Artificial Sequence
  synthesized
uugaaugcagccaaggguca

SEQ ID NO: 1727 - RNA, 20 nt, Artificial Sequence
  synthesized
uugaaugcauccaaggguca

SEQ ID NO: 1728 - RNA, 20 nt, Artificial Sequence
  synthesized
acugcccuugagccugggua

SEQ ID NO: 1729 - RNA, 20 nt, Artificial Sequence
  synthesized
acugugccacugcccuugag

SEQ ID NO: 1730 - RNA, 20 nt, Artificial Sequence
  synthesized
acugugccgcugcccuugag

SEQ ID NO: 1731 - RNA, 20 nt, Artificial Sequence
  synthesized
agggcagcggcacagucaug

SEQ ID NO: 1732 - RNA, 20 nt, Artificial Sequence
  synthesized
caggcucaagggcagcggca

SEQ ID NO: 1733 - RNA, 20 nt, Artificial Sequence
  synthesized
caggcucaagggcaguggca

SEQ ID NO: 1734 - RNA, 20 nt, Artificial Sequence
  synthesized
ccacugcccuugagccuggg

SEQ ID NO: 1735 - RNA, 20 nt, Artificial Sequence
  synthesized
ccgcugcccuugagccuggg

SEQ ID NO: 1736 - RNA, 20 nt, Artificial Sequence
  synthesized
cucaagggcagcggcacagu

SEQ ID NO: 1737 - RNA, 20 nt, Artificial Sequence
  synthesized
gagucaugacugugccgcug

SEQ ID NO: 1738 - RNA, 20 nt, Artificial Sequence
  synthesized
gcugcccuugagccugggua

SEQ ID NO: 1739 - RNA, 20 nt, Artificial Sequence
  synthesized
ggcagcggcacagucaugac

SEQ ID NO: 1740 - RNA, 20 nt, Artificial Sequence
  synthesized
ggcucaagggcagcggcaca

SEQ ID NO: 1741 - RNA, 20 nt, Artificial Sequence
  synthesized
ggcucaagggcaguggcaca

SEQ ID NO: 1742 - RNA, 20 nt, Artificial Sequence
  synthesized
gucaugacugugccgcugcc

SEQ ID NO: 1743 - RNA, 20 nt, Artificial Sequence
  synthesized
gugagucaugacugugccgc

SEQ ID NO: 1744 - RNA, 20 nt, Artificial Sequence
  synthesized
uacccaggcucaagggcagc

SEQ ID NO: 1745 - RNA, 20 nt, Artificial Sequence
  synthesized
ugacugugccacugcccuug

SEQ ID NO: 1746 - RNA, 20 nt, Artificial Sequence
  synthesized
ugacugugccgcugcccuug

SEQ ID NO: 1747 - RNA, 20 nt, Artificial Sequence
  synthesized
aacgucuaacuucaguuuca

SEQ ID NO: 1748 - RNA, 20 nt, Artificial Sequence
  synthesized
aacgucuaacuucaguuucu

SEQ ID NO: 1749 - RNA, 20 nt, Artificial Sequence
  synthesized
acuucaguuucacuggcugc

SEQ ID NO: 1750 - RNA, 20 nt, Artificial Sequence
  synthesized
acuucaguuucucuggcugc

SEQ ID NO: 1751 - RNA, 20 nt, Artificial Sequence
  synthesized
agccagagaaacugaaguua

SEQ ID NO: 1752 - RNA, 20 nt, Artificial Sequence
  synthesized
agccagugaaacugaaguua

SEQ ID NO: 1753 - RNA, 20 nt, Artificial Sequence
  synthesized
cacuggcugcaguccgcacc

SEQ ID NO: 1754 - RNA, 20 nt, Artificial Sequence
  synthesized
caguuucacuggcugcaguc

SEQ ID NO: 1755 - RNA, 20 nt, Artificial Sequence
  synthesized
caguuucucuggcugcaguc

SEQ ID NO: 1756 - RNA, 20 nt, Artificial Sequence
  synthesized
ccagagaaacugaaguuaga

SEQ ID NO: 1757 - RNA, 20 nt, Artificial Sequence
  synthesized
ccagugaaacugaaguuaga

SEQ ID NO: 1758 - RNA, 20 nt, Artificial Sequence
  synthesized
cgucuaacuucaguuucacu

SEQ ID NO: 1759 - RNA, 20 nt, Artificial Sequence
  synthesized
cgucuaacuucaguuucucu

SEQ ID NO: 1760 - RNA, 20 nt, Artificial Sequence
  synthesized
cucuggcugcaguccgcacc

SEQ ID NO: 1761 - RNA, 20 nt, Artificial Sequence
  synthesized
cugcagccagagaaacugaa

SEQ ID NO: 1762 - RNA, 20 nt, Artificial Sequence
  synthesized
cugcagccagugaaacugaa

SEQ ID NO: 1763 - RNA, 20 nt, Artificial Sequence
  synthesized
gacugcagccagagaaacug

SEQ ID NO: 1764 - RNA, 20 nt, Artificial Sequence
  synthesized
gacugcagccagugaaacug

SEQ ID NO: 1765 - RNA, 20 nt, Artificial Sequence
  synthesized
gcagccagagaaacugaagu

SEQ ID NO: 1766 - RNA, 20 nt, Artificial Sequence
  synthesized
gcagccagugaaacugaagu

SEQ ID NO: 1767 - RNA, 20 nt, Artificial Sequence
  synthesized
ggugcggacugcagccagag

SEQ ID NO: 1768 - RNA, 20 nt, Artificial Sequence
  synthesized
ggugcggacugcagccagug

SEQ ID NO: 1769 - RNA, 20 nt, Artificial Sequence
  synthesized
guuucacuggcugcaguccg

SEQ ID NO: 1770 - RNA, 20 nt, Artificial Sequence
  synthesized
guuucucuggcugcaguccg

SEQ ID NO: 1771 - RNA, 20 nt, Artificial Sequence
  synthesized
uaacuucaguuucacuggcu

SEQ ID NO: 1772 - RNA, 20 nt, Artificial Sequence
  synthesized
uaacuucaguuucucuggcu

SEQ ID NO: 1773 - RNA, 20 nt, Artificial Sequence
  synthesized
ucuaacuucaguuucacugg

SEQ ID NO: 1774 - RNA, 20 nt, Artificial Sequence
  synthesized
ucuaacuucaguuucucugg

SEQ ID NO: 1775 - RNA, 20 nt, Artificial Sequence
  synthesized
ugcggacugcagccagagaa

SEQ ID NO: 1776 - RNA, 20 nt, Artificial Sequence
  synthesized
ugcggacugcagccagugaa

SEQ ID NO: 1777 - RNA, 20 nt, Artificial Sequence
  synthesized
uucacuggcugcaguccgca

SEQ ID NO: 1778 - RNA, 20 nt, Artificial Sequence
  synthesized
uucaguuucacuggcugcag

SEQ ID NO: 1779 - RNA, 20 nt, Artificial Sequence
  synthesized
uucaguuucucuggcugcag

SEQ ID NO: 1780 - RNA, 20 nt, Artificial Sequence
  synthesized
uucucuggcugcaguccgca

SEQ ID NO: 1781 - RNA, 20 nt, Artificial Sequence
  synthesized
aggcuaggcgugguggcucu

SEQ ID NO: 1782 - RNA, 20 nt, Artificial Sequence
  synthesized
aggcuaggcgugguggcugu

SEQ ID NO: 1783 - RNA, 20 nt, Artificial Sequence
  synthesized
caggcgacagccaccacgcc

SEQ ID NO: 1784 - RNA, 20 nt, Artificial Sequence
  synthesized
cgugguggcucucgccugua

SEQ ID NO: 1785 - RNA, 20 nt, Artificial Sequence
  synthesized
gcuaggcgugguggcugucg

SEQ ID NO: 1786 - RNA, 20 nt, Artificial Sequence
  synthesized
ggauuacaggcgagagccac

SEQ ID NO: 1787 - RNA, 20 nt, Artificial Sequence
  synthesized
ggcgacagccaccacgccua

SEQ ID NO: 1788 - RNA, 20 nt, Artificial Sequence
  synthesized
ggcgagagccaccacgccua

SEQ ID NO: 1789 - RNA, 20 nt, Artificial Sequence
  synthesized
ggcucucgccuguaauccca

SEQ ID NO: 1790 - RNA, 20 nt, Artificial Sequence
  synthesized
aaucuugaccacaccccacu

SEQ ID NO: 1791 - RNA, 20 nt, Artificial Sequence
  synthesized
aaucuugacuacaccccacu

SEQ ID NO: 1792 - RNA, 20 nt, Artificial Sequence
  synthesized
agucaagauuugggggucca

SEQ ID NO: 1793 - RNA, 20 nt, Artificial Sequence
  synthesized
caaaucuugaccacacccca

SEQ ID NO: 1794 - RNA, 20 nt, Artificial Sequence
  synthesized
caaaucuugacuacacccca

SEQ ID NO: 1795 - RNA, 20 nt, Artificial Sequence
  synthesized
caggagugggguguagucaa

SEQ ID NO: 1796 - RNA, 20 nt, Artificial Sequence
  synthesized
caggagugggguguggucaa

SEQ ID NO: 1797 - RNA, 20 nt, Artificial Sequence
  synthesized
ccacaccccacuccuggcuc

SEQ ID NO: 1798 - RNA, 20 nt, Artificial Sequence
  synthesized
cccaaaucuugaccacaccc

SEQ ID NO: 1799 - RNA, 20 nt, Artificial Sequence
  synthesized
cccaaaucuugacuacaccc

SEQ ID NO: 1800 - RNA, 20 nt, Artificial Sequence
  synthesized
cccccaaaucuugaccacac

SEQ ID NO: 1801 - RNA, 20 nt, Artificial Sequence
  synthesized
cccccaaaucuugacuacac

SEQ ID NO: 1802 - RNA, 20 nt, Artificial Sequence
  synthesized
cuacaccccacuccuggcuc

SEQ ID NO: 1803 - RNA, 20 nt, Artificial Sequence
  synthesized
gaccacaccccacuccuggc

SEQ ID NO: 1804 - RNA, 20 nt, Artificial Sequence
  synthesized
gacccccaaaucuugaccac

SEQ ID NO: 1805 - RNA, 20 nt, Artificial Sequence
  synthesized
gacccccaaaucuugacuac

SEQ ID NO: 1806 - RNA, 20 nt, Artificial Sequence
  synthesized
gacuacaccccacuccuggc

SEQ ID NO: 1807 - RNA, 20 nt, Artificial Sequence
  synthesized
gccaggagugggguguaguc

SEQ ID NO: 1808 - RNA, 20 nt, Artificial Sequence
  synthesized
gccaggaguggggugugguc

SEQ ID NO: 1809 - RNA, 20 nt, Artificial Sequence
  synthesized
ggagugggguguagucaaga

SEQ ID NO: 1810 - RNA, 20 nt, Artificial Sequence
  synthesized
ggagugggguguggucaaga

SEQ ID NO: 1811 - RNA, 20 nt, Artificial Sequence
  synthesized
ggguguagucaagauuuggg

SEQ ID NO: 1812 - RNA, 20 nt, Artificial Sequence
  synthesized
ggguguggucaagauuuggg

SEQ ID NO: 1813 - RNA, 20 nt, Artificial Sequence
  synthesized
ggucaagauuugggggucca

SEQ ID NO: 1814 - RNA, 20 nt, Artificial Sequence
  synthesized
guagucaagauuuggggguc

SEQ ID NO: 1815 - RNA, 20 nt, Artificial Sequence
  synthesized
guggucaagauuuggggguc

SEQ ID NO: 1816 - RNA, 20 nt, Artificial Sequence
  synthesized
guguagucaagauuuggggg

SEQ ID NO: 1817 - RNA, 20 nt, Artificial Sequence
  synthesized
guguggucaagauuuggggg

SEQ ID NO: 1818 - RNA, 20 nt, Artificial Sequence
  synthesized
uggacccccaaaucuugacc

SEQ ID NO: 1819 - RNA, 20 nt, Artificial Sequence
  synthesized
uggacccccaaaucuugacu

SEQ ID NO: 1820 - RNA, 20 nt, Artificial Sequence
  synthesized
uugaccacaccccacuccug

SEQ ID NO: 1821 - RNA, 20 nt, Artificial Sequence
  synthesized
uugacuacaccccacuccug

SEQ ID NO: 1822 - RNA, 20 nt, Artificial Sequence
  synthesized
accaccgugcccgucccaaa

SEQ ID NO: 1823 - RNA, 20 nt, Artificial Sequence
  synthesized
accaccuugcccgucccaaa

SEQ ID NO: 1824 - RNA, 20 nt, Artificial Sequence
  synthesized
caccgugcccgucccaaaca

SEQ ID NO: 1825 - RNA, 20 nt, Artificial Sequence
  synthesized
caccuugcccgucccaaaca

SEQ ID NO: 1826 - RNA, 20 nt, Artificial Sequence
  synthesized
ccgugcccgucccaaacacu

SEQ ID NO: 1827 - RNA, 20 nt, Artificial Sequence
  synthesized
ccuugcccgucccaaacacu

SEQ ID NO: 1828 - RNA, 20 nt, Artificial Sequence
  synthesized
gaaccaccgugcccguccca

SEQ ID NO: 1829 - RNA, 20 nt, Artificial Sequence
  synthesized
gaaccaccuugcccguccca

SEQ ID NO: 1830 - RNA, 20 nt, Artificial Sequence
  synthesized
gcgugaaccaccgugcccgu

SEQ ID NO: 1831 - RNA, 20 nt, Artificial Sequence
  synthesized
gcgugaaccaccuugcccgu

SEQ ID NO: 1832 - RNA, 20 nt, Artificial Sequence
  synthesized
gugaaccaccgugcccgucc

SEQ ID NO: 1833 - RNA, 20 nt, Artificial Sequence
  synthesized
gugaaccaccuugcccgucc

SEQ ID NO: 1834 - RNA, 20 nt, Artificial Sequence
  synthesized
gugcccgucccaaacacucu

SEQ ID NO: 1835 - RNA, 20 nt, Artificial Sequence
  synthesized
ugggacgggcaaggugguuc

SEQ ID NO: 1836 - RNA, 20 nt, Artificial Sequence
  synthesized
ugggacgggcacggugguuc

SEQ ID NO: 1837 - RNA, 20 nt, Artificial Sequence
  synthesized
uguuugggacgggcaaggug

SEQ ID NO: 1838 - RNA, 20 nt, Artificial Sequence
  synthesized
uguuugggacgggcacggug

SEQ ID NO: 1839 - RNA, 20 nt, Artificial Sequence
  synthesized
uugcccgucccaaacacucu

SEQ ID NO: 1840 - RNA, 20 nt, Artificial Sequence
  synthesized
aacccuucccacucugcggc

SEQ ID NO: 1841 - RNA, 20 nt, Artificial Sequence
  synthesized
acaacccuucccacucugcg

SEQ ID NO: 1842 - RNA, 20 nt, Artificial Sequence
  synthesized
acagcccuucccacucugcg

SEQ ID NO: 1843 - RNA, 20 nt, Artificial Sequence
  synthesized
agcccuucccacucugcggc

SEQ ID NO: 1844 - RNA, 20 nt, Artificial Sequence
  synthesized
agggcugugguccacaggaa

SEQ ID NO: 1845 - RNA, 20 nt, Artificial Sequence
  synthesized
aggguugugguccacaggaa

SEQ ID NO: 1846 - RNA, 20 nt, Artificial Sequence
  synthesized
cagagugggaagggcugugg

SEQ ID NO: 1847 - RNA, 20 nt, Artificial Sequence
  synthesized
cagagugggaaggguugugg

SEQ ID NO: 1848 - RNA, 20 nt, Artificial Sequence
  synthesized
ccuguggaccacaacccuuc

SEQ ID NO: 1849 - RNA, 20 nt, Artificial Sequence
  synthesized
ccuguggaccacagcccuuc

SEQ ID NO: 1850 - RNA, 20 nt, Artificial Sequence
  synthesized
cgcagagugggaagggcugu

SEQ ID NO: 1851 - RNA, 20 nt, Artificial Sequence
  synthesized
cgcagagugggaaggguugu

SEQ ID NO: 1852 - RNA, 20 nt, Artificial Sequence
  synthesized
cugugguccacaggaaacaa

SEQ ID NO: 1853 - RNA, 20 nt, Artificial Sequence
  synthesized
gaagggcugugguccacagg

SEQ ID NO: 1854 - RNA, 20 nt, Artificial Sequence
  synthesized
gaaggguugugguccacagg

SEQ ID NO: 1855 - RNA, 20 nt, Artificial Sequence
  synthesized
gagugggaagggcugugguc

SEQ ID NO: 1856 - RNA, 20 nt, Artificial Sequence
  synthesized
gagugggaaggguugugguc

SEQ ID NO: 1857 - RNA, 20 nt, Artificial Sequence
  synthesized
gccgcagagugggaagggcu

SEQ ID NO: 1858 - RNA, 20 nt, Artificial Sequence
  synthesized
gccgcagagugggaaggguu

SEQ ID NO: 1859 - RNA, 20 nt, Artificial Sequence
  synthesized
ggcugugguccacaggaaac

SEQ ID NO: 1860 - RNA, 20 nt, Artificial Sequence
  synthesized
gguugugguccacaggaaac

SEQ ID NO: 1861 - RNA, 20 nt, Artificial Sequence
  synthesized
gugggaagggcuguggucca

SEQ ID NO: 1862 - RNA, 20 nt, Artificial Sequence
  synthesized
gugggaaggguuguggucca

SEQ ID NO: 1863 - RNA, 20 nt, Artificial Sequence
  synthesized
guuuccuguggaccacaacc

SEQ ID NO: 1864 - RNA, 20 nt, Artificial Sequence
  synthesized
guuuccuguggaccacagcc

SEQ ID NO: 1865 - RNA, 20 nt, Artificial Sequence
  synthesized
uggaccacaacccuucccac

SEQ ID NO: 1866 - RNA, 20 nt, Artificial Sequence
  synthesized
uggaccacagcccuucccac

SEQ ID NO: 1867 - RNA, 20 nt, Artificial Sequence
  synthesized
uguggaccacaacccuuccc

SEQ ID NO: 1868 - RNA, 20 nt, Artificial Sequence
  synthesized
uguggaccacagcccuuccc

SEQ ID NO: 1869 - RNA, 20 nt, Artificial Sequence
  synthesized
uuccuguggaccacaacccu

SEQ ID NO: 1870 - RNA, 20 nt, Artificial Sequence
  synthesized
uuccuguggaccacagcccu

SEQ ID NO: 1871 - RNA, 20 nt, Artificial Sequence
  synthesized
uugugguccacaggaaacaa

SEQ ID NO: 1872 - RNA, 20 nt, Artificial Sequence
  synthesized
uuguuuccuguggaccacaa

SEQ ID NO: 1873 - RNA, 20 nt, Artificial Sequence
  synthesized
uuguuuccuguggaccacag

SEQ ID NO: 1874 - RNA, 20 nt, Artificial Sequence
  synthesized
caccugggaggaggaggagg

SEQ ID NO: 1875 - RNA, 20 nt, Artificial Sequence
  synthesized
ccugggaggaggaggaggau

SEQ ID NO: 1876 - RNA, 20 nt, Artificial Sequence
  synthesized
accaaugcaugcugaaaaag

SEQ ID NO: 1877 - RNA, 20 nt, Artificial Sequence
  synthesized
acuaaugcaugcugaaaaag

SEQ ID NO: 1878 - RNA, 20 nt, Artificial Sequence
  synthesized
augcauuagugcccaaguaa

SEQ ID NO: 1879 - RNA, 20 nt, Artificial Sequence
  synthesized
augcauuggugcccaaguaa

SEQ ID NO: 1880 - RNA, 20 nt, Artificial Sequence
  synthesized
auuagugcccaaguaaaaac

SEQ ID NO: 1881 - RNA, 20 nt, Artificial Sequence
  synthesized
auuggugcccaaguaaaaac

SEQ ID NO: 1882 - RNA, 20 nt, Artificial Sequence
  synthesized
caaugcaugcugaaaaagag

SEQ ID NO: 1883 - RNA, 20 nt, Artificial Sequence
  synthesized
cagcaugcauuagugcccaa

SEQ ID NO: 1884 - RNA, 20 nt, Artificial Sequence
  synthesized
cagcaugcauuggugcccaa

SEQ ID NO: 1885 - RNA, 20 nt, Artificial Sequence
  synthesized
cucuuuuucagcaugcauua

SEQ ID NO: 1886 - RNA, 20 nt, Artificial Sequence
  synthesized
cucuuuuucagcaugcauug

SEQ ID NO: 1887 - RNA, 20 nt, Artificial Sequence
  synthesized
cuuuuucagcaugcauuagu

SEQ ID NO: 1888 - RNA, 20 nt, Artificial Sequence
  synthesized
cuuuuucagcaugcauuggu

SEQ ID NO: 1889 - RNA, 20 nt, Artificial Sequence
  synthesized
gcauuagugcccaaguaaaa

SEQ ID NO: 1890 - RNA, 20 nt, Artificial Sequence
  synthesized
gcauuggugcccaaguaaaa

SEQ ID NO: 1891 - RNA, 20 nt, Artificial Sequence
  synthesized
gggcaccaaugcaugcugaa

SEQ ID NO: 1892 - RNA, 20 nt, Artificial Sequence
  synthesized
gggcacuaaugcaugcugaa

SEQ ID NO: 1893 - RNA, 20 nt, Artificial Sequence
  synthesized
guuuuuacuugggcaccaau

SEQ ID NO: 1894 - RNA, 20 nt, Artificial Sequence
  synthesized
guuuuuacuugggcacuaau

SEQ ID NO: 1895 - RNA, 20 nt, Artificial Sequence
  synthesized
uaaugcaugcugaaaaagag

SEQ ID NO: 1896 - RNA, 20 nt, Artificial Sequence
  synthesized
uagugcccaaguaaaaacca

SEQ ID NO: 1897 - RNA, 20 nt, Artificial Sequence
  synthesized
uggugcccaaguaaaaacca

SEQ ID NO: 1898 - RNA, 20 nt, Artificial Sequence
  synthesized
ugguuuuuacuugggcacca

SEQ ID NO: 1899 - RNA, 20 nt, Artificial Sequence
  synthesized
ugguuuuuacuugggcacua

SEQ ID NO: 1900 - RNA, 20 nt, Artificial Sequence
  synthesized
uuacuugggcaccaaugcau

SEQ ID NO: 1901 - RNA, 20 nt, Artificial Sequence
  synthesized
uuacuugggcacuaaugcau

SEQ ID NO: 1902 - RNA, 20 nt, Artificial Sequence
  synthesized
uucagcaugcauuagugccc

SEQ ID NO: 1903 - RNA, 20 nt, Artificial Sequence
  synthesized
uucagcaugcauuggugccc

SEQ ID NO: 1904 - RNA, 20 nt, Artificial Sequence
  synthesized
uugggcaccaaugcaugcug

SEQ ID NO: 1905 - RNA, 20 nt, Artificial Sequence
  synthesized
uugggcacuaaugcaugcug

SEQ ID NO: 1906 - RNA, 20 nt, Artificial Sequence
  synthesized
uuuuacuugggcaccaaugc

SEQ ID NO: 1907 - RNA, 20 nt, Artificial Sequence
  synthesized
uuuuacuugggcacuaaugc

SEQ ID NO: 1908 - RNA, 20 nt, Artificial Sequence
  synthesized
accucuuauccagguaccag

SEQ ID NO: 1909 - RNA, 20 nt, Artificial Sequence
  synthesized
accucuucuccagguaccag

SEQ ID NO: 1910 - RNA, 20 nt, Artificial Sequence
  synthesized
ccccaccucuuauccaggua

SEQ ID NO: 1911 - RNA, 20 nt, Artificial Sequence
  synthesized
ccccaccucuucuccaggua

SEQ ID NO: 1912 - RNA, 20 nt, Artificial Sequence
  synthesized
cccugguaccuggagaagag

SEQ ID NO: 1913 - RNA, 20 nt, Artificial Sequence
  synthesized
cccugguaccuggauaagag

SEQ ID NO: 1914 - RNA, 20 nt, Artificial Sequence
  synthesized
ccuggagaagaggugggggc

SEQ ID NO: 1915 - RNA, 20 nt, Artificial Sequence
  synthesized
ccuggauaagaggugggggc

SEQ ID NO: 1916 - RNA, 20 nt, Artificial Sequence
  synthesized
gagaagaggugggggcgagc

SEQ ID NO: 1917 - RNA, 20 nt, Artificial Sequence
  synthesized
gauaagaggugggggcgagc

SEQ ID NO: 1918 - RNA, 20 nt, Artificial Sequence
  synthesized
gcccccaccucuuauccagg

SEQ ID NO: 1919 - RNA, 20 nt, Artificial Sequence
  synthesized
gcccccaccucuucuccagg

SEQ ID NO: 1920 - RNA, 20 nt, Artificial Sequence
  synthesized
gcucgcccccaccucuuauc

SEQ ID NO: 1921 - RNA, 20 nt, Artificial Sequence
  synthesized
gcucgcccccaccucuucuc

SEQ ID NO: 1922 - RNA, 20 nt, Artificial Sequence
  synthesized
gggcucgcccccaccucuua

SEQ ID NO: 1923 - RNA, 20 nt, Artificial Sequence
  synthesized
gggcucgcccccaccucuuc

SEQ ID NO: 1924 - RNA, 20 nt, Artificial Sequence
  synthesized
uauccagguaccagggccug

SEQ ID NO: 1925 - RNA, 20 nt, Artificial Sequence
  synthesized
ucgcccccaccucuuaucca

SEQ ID NO: 1926 - RNA, 20 nt, Artificial Sequence
  synthesized
ucgcccccaccucuucucca

SEQ ID NO: 1927 - RNA, 20 nt, Artificial Sequence
  synthesized
ucuccagguaccagggccug

SEQ ID NO: 1928 - RNA, 20 nt, Artificial Sequence
  synthesized
uggagaagaggugggggcga

SEQ ID NO: 1929 - RNA, 20 nt, Artificial Sequence
  synthesized
uggauaagaggugggggcga

SEQ ID NO: 1930 - RNA, 20 nt, Artificial Sequence
  synthesized
caccaagcccagcuaauuuu

SEQ ID NO: 1931 - RNA, 20 nt, Artificial Sequence
  synthesized
acacgccuaucuacaucuuc

SEQ ID NO: 1932 - RNA, 20 nt, Artificial Sequence
  synthesized
acacgccuaucuacgucuuc

SEQ ID NO: 1933 - RNA, 20 nt, Artificial Sequence
  synthesized
acgccuaucuacaucuuccc

SEQ ID NO: 1934 - RNA, 20 nt, Artificial Sequence
  synthesized
acgccuaucuacgucuuccc

SEQ ID NO: 1935 - RNA, 20 nt, Artificial Sequence
  synthesized
acguagauaggcgugugcau

SEQ ID NO: 1936 - RNA, 20 nt, Artificial Sequence
  synthesized
agacguagauaggcgugugc

SEQ ID NO: 1937 - RNA, 20 nt, Artificial Sequence
  synthesized
agauguagauaggcgugugc

SEQ ID NO: 1938 - RNA, 20 nt, Artificial Sequence
  synthesized
aucuacaucuucccugccaa

SEQ ID NO: 1939 - RNA, 20 nt, Artificial Sequence
  synthesized
aucuacgucuucccugccaa

SEQ ID NO: 1940 - RNA, 20 nt, Artificial Sequence
  synthesized
augcacacgccuaucuacau

SEQ ID NO: 1941 - RNA, 20 nt, Artificial Sequence
  synthesized
augcacacgccuaucuacgu

SEQ ID NO: 1942 - RNA, 20 nt, Artificial Sequence
  synthesized
auguagauaggcgugugcau

SEQ ID NO: 1943 - RNA, 20 nt, Artificial Sequence
  synthesized
cagggaagacguagauaggc

SEQ ID NO: 1944 - RNA, 20 nt, Artificial Sequence
  synthesized
cagggaagauguagauaggc

SEQ ID NO: 1945 - RNA, 20 nt, Artificial Sequence
  synthesized
cuacaucuucccugccaaag

SEQ ID NO: 1946 - RNA, 20 nt, Artificial Sequence
  synthesized
cuacgucuucccugccaaag

SEQ ID NO: 1947 - RNA, 20 nt, Artificial Sequence
  synthesized
cuaucuacaucuucccugcc

SEQ ID NO: 1948 - RNA, 20 nt, Artificial Sequence
  synthesized
cuaucuacgucuucccugcc

SEQ ID NO: 1949 - RNA, 20 nt, Artificial Sequence
  synthesized
cuuuggcagggaagacguag

SEQ ID NO: 1950 - RNA, 20 nt, Artificial Sequence
  synthesized
cuuuggcagggaagauguag

SEQ ID NO: 1951 - RNA, 20 nt, Artificial Sequence
  synthesized
gaagacguagauaggcgugu

SEQ ID NO: 1952 - RNA, 20 nt, Artificial Sequence
  synthesized
gaagauguagauaggcgugu

SEQ ID NO: 1953 - RNA, 20 nt, Artificial Sequence
  synthesized
gcacacgccuaucuacaucu

SEQ ID NO: 1954 - RNA, 20 nt, Artificial Sequence
  synthesized
gcacacgccuaucuacgucu

SEQ ID NO: 1955 - RNA, 20 nt, Artificial Sequence
  synthesized
gccuaucuacaucuucccug

SEQ ID NO: 1956 - RNA, 20 nt, Artificial Sequence
  synthesized
gccuaucuacgucuucccug

SEQ ID NO: 1957 - RNA, 20 nt, Artificial Sequence
  synthesized
ggcagggaagacguagauag

SEQ ID NO: 1958 - RNA, 20 nt, Artificial Sequence
  synthesized
ggcagggaagauguagauag

SEQ ID NO: 1959 - RNA, 20 nt, Artificial Sequence
  synthesized
gggaagacguagauaggcgu

SEQ ID NO: 1960 - RNA, 20 nt, Artificial Sequence
  synthesized
gggaagauguagauaggcgu

SEQ ID NO: 1961 - RNA, 20 nt, Artificial Sequence
  synthesized
aaccauuugauucaggcugu

SEQ ID NO: 1962 - RNA, 20 nt, Artificial Sequence
  synthesized
acagccugaaucaaauggcu

SEQ ID NO: 1963 - RNA, 20 nt, Artificial Sequence
  synthesized
acagccugaaucaaaugguu

SEQ ID NO: 1964 - RNA, 20 nt, Artificial Sequence
  synthesized
agccauuugauucaggcugu

SEQ ID NO: 1965 - RNA, 20 nt, Artificial Sequence
  synthesized
agcuaaccauuugauucagg

SEQ ID NO: 1966 - RNA, 20 nt, Artificial Sequence
  synthesized
agcuagccauuugauucagg

SEQ ID NO: 1967 - RNA, 20 nt, Artificial Sequence
  synthesized
aucuauuaagcuagccauuu

SEQ ID NO: 1968 - RNA, 20 nt, Artificial Sequence
  synthesized
auggcuagcuuaauagauaa

SEQ ID NO: 1969 - RNA, 20 nt, Artificial Sequence
  synthesized
auuaagcuagccauuugauu

SEQ ID NO: 1970 - RNA, 20 nt, Artificial Sequence
  synthesized
ccugaaucaaauggcuagcu

SEQ ID NO: 1971 - RNA, 20 nt, Artificial Sequence
  synthesized
ccugaaucaaaugguuagcu

SEQ ID NO: 1972 - RNA, 20 nt, Artificial Sequence
  synthesized
cuaaccauuugauucaggcu

SEQ ID NO: 1973 - RNA, 20 nt, Artificial Sequence
  synthesized
cuagccauuugauucaggcu

SEQ ID NO: 1974 - RNA, 20 nt, Artificial Sequence
  synthesized
cuauuaagcuaaccauuuga

SEQ ID NO: 1975 - RNA, 20 nt, Artificial Sequence
  synthesized
cuauuaagcuagccauuuga

SEQ ID NO: 1976 - RNA, 20 nt, Artificial Sequence
  synthesized
ggcuagcuuaauagauaaaa

SEQ ID NO: 1977 - RNA, 20 nt, Artificial Sequence
  synthesized
uaagcuaaccauuugauuca

SEQ ID NO: 1978 - RNA, 20 nt, Artificial Sequence
  synthesized
uaagcuagccauuugauuca

SEQ ID NO: 1979 - RNA, 20 nt, Artificial Sequence
  synthesized
ucaaauggcuagcuuaauag

SEQ ID NO: 1980 - RNA, 20 nt, Artificial Sequence
  synthesized
ucaaaugguuagcuuaauag

SEQ ID NO: 1981 - RNA, 20 nt, Artificial Sequence
  synthesized
uuaucuauuaagcuagccau

SEQ ID NO: 1982 - RNA, 20 nt, Artificial Sequence
  synthesized
aaaucuggaagauagccugg

SEQ ID NO: 1983 - RNA, 20 nt, Artificial Sequence
  synthesized
aacaacggcacuuaagaaau

SEQ ID NO: 1984 - RNA, 20 nt, Artificial Sequence
  synthesized
aacaacggcacuuaaggaau

SEQ ID NO: 1985 - RNA, 20 nt, Artificial Sequence
  synthesized
acggcacuuaagaaaucugg

SEQ ID NO: 1986 - RNA, 20 nt, Artificial Sequence
  synthesized
acggcacuuaaggaaucugg

SEQ ID NO: 1987 - RNA, 20 nt, Artificial Sequence
  synthesized
agauuccuuaagugccguug

SEQ ID NO: 1988 - RNA, 20 nt, Artificial Sequence
  synthesized
agauuucuuaagugccguug

SEQ ID NO: 1989 - RNA, 20 nt, Artificial Sequence
  synthesized
aggcuaucuuccagauuccu

SEQ ID NO: 1990 - RNA, 20 nt, Artificial Sequence
  synthesized
aggcuaucuuccagauuucu

SEQ ID NO: 1991 - RNA, 20 nt, Artificial Sequence
  synthesized
auuccuuaagugccguuguu

SEQ ID NO: 1992 - RNA, 20 nt, Artificial Sequence
  synthesized
auuucuuaagugccguuguu

SEQ ID NO: 1993 - RNA, 20 nt, Artificial Sequence
  synthesized
cacuuaagaaaucuggaaga

SEQ ID NO: 1994 - RNA, 20 nt, Artificial Sequence
  synthesized
cacuuaaggaaucuggaaga

SEQ ID NO: 1995 - RNA, 20 nt, Artificial Sequence
  synthesized
ccagauuccuuaagugccgu

SEQ ID NO: 1996 - RNA, 20 nt, Artificial Sequence
  synthesized
ccagauuucuuaagugccgu

SEQ ID NO: 1997 - RNA, 20 nt, Artificial Sequence
  synthesized
ccaggcuaucuuccagauuc

SEQ ID NO: 1998 - RNA, 20 nt, Artificial Sequence
  synthesized
ccaggcuaucuuccagauuu

SEQ ID NO: 1999 - RNA, 20 nt, Artificial Sequence
  synthesized
cuuaagaaaucuggaagaua

SEQ ID NO: 2000 - RNA, 20 nt, Artificial Sequence
  synthesized
cuuaaggaaucuggaagaua

SEQ ID NO: 2001 - RNA, 20 nt, Artificial Sequence
  synthesized
gaaucuggaagauagccugg

SEQ ID NO: 2002 - RNA, 20 nt, Artificial Sequence
  synthesized
uaucuuccagauuccuuaag

SEQ ID NO: 2003 - RNA, 20 nt, Artificial Sequence
  synthesized
uaucuuccagauuucuuaag

SEQ ID NO: 2004 - RNA, 20 nt, Artificial Sequence
  synthesized
uccuuaagugccguuguuca

SEQ ID NO: 2005 - RNA, 20 nt, Artificial Sequence
  synthesized
ucuuccagauuccuuaagug

SEQ ID NO: 2006 - RNA, 20 nt, Artificial Sequence
  synthesized
ucuuccagauuucuuaagug

SEQ ID NO: 2007 - RNA, 20 nt, Artificial Sequence
  synthesized
ugaacaacggcacuuaagaa

SEQ ID NO: 2008 - RNA, 20 nt, Artificial Sequence
  synthesized
ugaacaacggcacuuaagga

SEQ ID NO: 2009 - RNA, 20 nt, Artificial Sequence
  synthesized
uuccagauuccuuaagugcc

SEQ ID NO: 2010 - RNA, 20 nt, Artificial Sequence
  synthesized
uuccagauuucuuaagugcc

SEQ ID NO: 2011 - RNA, 20 nt, Artificial Sequence
  synthesized
uucuuaagugccguuguuca

SEQ ID NO: 2012 - RNA, 20 nt, Artificial Sequence
  synthesized
agcucaggcagcccugaucc

SEQ ID NO: 2013 - RNA, 20 nt, Artificial Sequence
  synthesized
agcucaggcagccgugaucc

SEQ ID NO: 2014 - RNA, 20 nt, Artificial Sequence
  synthesized
agggaucacggcugccugag

SEQ ID NO: 2015 - RNA, 20 nt, Artificial Sequence
  synthesized
agggaucagggcugccugag

SEQ ID NO: 2016 - RNA, 20 nt, Artificial Sequence
  synthesized
cacggcugccugagcucagg

SEQ ID NO: 2017 - RNA, 20 nt, Artificial Sequence
  synthesized
cagggaucagggcugccuga

SEQ ID NO: 2018 - RNA, 20 nt, Artificial Sequence
  synthesized
cagggcugccugagcucagg

SEQ ID NO: 2019 - RNA, 20 nt, Artificial Sequence
  synthesized
cccugagcucaggcagcccu

SEQ ID NO: 2020 - RNA, 20 nt, Artificial Sequence
  synthesized
cccugaucccugaaggacgg

SEQ ID NO: 2021 - RNA, 20 nt, Artificial Sequence
  synthesized
ccguccuucagggaucaggg

SEQ ID NO: 2022 - RNA, 20 nt, Artificial Sequence
  synthesized
ccugagcucaggcagcccug

SEQ ID NO: 2023 - RNA, 20 nt, Artificial Sequence
  synthesized
ccugagcucaggcagccgug

SEQ ID NO: 2024 - RNA, 20 nt, Artificial Sequence
  synthesized
ccugaucccugaaggacgga

SEQ ID NO: 2025 - RNA, 20 nt, Artificial Sequence
  synthesized
ccuucagggaucagggcugc

SEQ ID NO: 2026 - RNA, 20 nt, Artificial Sequence
  synthesized
cguccuucagggaucacggc

SEQ ID NO: 2027 - RNA, 20 nt, Artificial Sequence
  synthesized
cguccuucagggaucagggc

SEQ ID NO: 2028 - RNA, 20 nt, Artificial Sequence
  synthesized
cgugaucccugaaggacgga

SEQ ID NO: 2029 - RNA, 20 nt, Artificial Sequence
  synthesized
cucaggcagcccugaucccu

SEQ ID NO: 2030 - RNA, 20 nt, Artificial Sequence
  synthesized
cucaggcagccgugaucccu

SEQ ID NO: 2031 - RNA, 20 nt, Artificial Sequence
  synthesized
cuccguccuucagggaucag

SEQ ID NO: 2032 - RNA, 20 nt, Artificial Sequence
  synthesized
cugagcucaggcagcccuga

SEQ ID NO: 2033 - RNA, 20 nt, Artificial Sequence
  synthesized
cugaucccugaaggacggag

SEQ ID NO: 2034 - RNA, 20 nt, Artificial Sequence
  synthesized
gagcucaggcagcccugauc

SEQ ID NO: 2035 - RNA, 20 nt, Artificial Sequence
  synthesized
gcagcccugaucccugaagg

SEQ ID NO: 2036 - RNA, 20 nt, Artificial Sequence
  synthesized
gcccugaucccugaaggacg

SEQ ID NO: 2037 - RNA, 20 nt, Artificial Sequence
  synthesized
gccgugaucccugaaggacg

SEQ ID NO: 2038 - RNA, 20 nt, Artificial Sequence
  synthesized
ggaucacggcugccugagcu

SEQ ID NO: 2039 - RNA, 20 nt, Artificial Sequence
  synthesized
ggaucagggcugccugagcu

SEQ ID NO: 2040 - RNA, 20 nt, Artificial Sequence
  synthesized
ggcagcccugaucccugaag

SEQ ID NO: 2041 - RNA, 20 nt, Artificial Sequence
  synthesized
ggcagccgugaucccugaag

SEQ ID NO: 2042 - RNA, 20 nt, Artificial Sequence
  synthesized
gggaucagggcugccugagc

SEQ ID NO: 2043 - RNA, 20 nt, Artificial Sequence
  synthesized
guccuucagggaucagggcu

SEQ ID NO: 2044 - RNA, 20 nt, Artificial Sequence
  synthesized
ucaggcagcccugaucccug

SEQ ID NO: 2045 - RNA, 20 nt, Artificial Sequence
  synthesized
ucagggaucacggcugccug

SEQ ID NO: 2046 - RNA, 20 nt, Artificial Sequence
  synthesized
ucagggaucagggcugccug

SEQ ID NO: 2047 - RNA, 20 nt, Artificial Sequence
  synthesized
uccguccuucagggaucacg

SEQ ID NO: 2048 - RNA, 20 nt, Artificial Sequence
  synthesized
uccguccuucagggaucagg

SEQ ID NO: 2049 - RNA, 20 nt, Artificial Sequence
  synthesized
uccuucagggaucacggcug

SEQ ID NO: 2050 - RNA, 20 nt, Artificial Sequence
  synthesized
uccuucagggaucagggcug

SEQ ID NO: 2051 - RNA, 20 nt, Artificial Sequence
  synthesized
ugagcucaggcagcccugau

SEQ ID NO: 2052 - RNA, 20 nt, Artificial Sequence
  synthesized
ugagcucaggcagccgugau

SEQ ID NO: 2053 - RNA, 20 nt, Artificial Sequence
  synthesized
uucagggaucagggcugccu

SEQ ID NO: 2054 - RNA, 20 nt, Artificial Sequence
  synthesized
agccccggcaggcuucuccu

SEQ ID NO: 2055 - RNA, 20 nt, Artificial Sequence
  synthesized
agccccggcaggcuucucuu

SEQ ID NO: 2056 - RNA, 20 nt, Artificial Sequence
  synthesized
cagagagauggaaagagaag

SEQ ID NO: 2057 - RNA, 20 nt, Artificial Sequence
  synthesized
cagagagauggaaggagaag

SEQ ID NO: 2058 - RNA, 20 nt, Artificial Sequence
  synthesized
caggcuucuccuuccaucuc

SEQ ID NO: 2059 - RNA, 20 nt, Artificial Sequence
  synthesized
caggcuucucuuuccaucuc

SEQ ID NO: 2060 - RNA, 20 nt, Artificial Sequence
  synthesized
ccccggcaggcuucuccuuc

SEQ ID NO: 2061 - RNA, 20 nt, Artificial Sequence
  synthesized
ccccggcaggcuucucuuuc

SEQ ID NO: 2062 - RNA, 20 nt, Artificial Sequence
  synthesized
ccggcaggcuucuccuucca

SEQ ID NO: 2063 - RNA, 20 nt, Artificial Sequence
  synthesized
ccggcaggcuucucuuucca

SEQ ID NO: 2064 - RNA, 20 nt, Artificial Sequence
  synthesized
cuuccaucucucugaagcaa

SEQ ID NO: 2065 - RNA, 20 nt, Artificial Sequence
  synthesized
cuucuccuuccaucucucug

SEQ ID NO: 2066 - RNA, 20 nt, Artificial Sequence
  synthesized
cuucucuuuccaucucucug

SEQ ID NO: 2067 - RNA, 20 nt, Artificial Sequence
  synthesized
gaaagagaagccugccgggg

SEQ ID NO: 2068 - RNA, 20 nt, Artificial Sequence
  synthesized
gaaggagaagccugccgggg

SEQ ID NO: 2069 - RNA, 20 nt, Artificial Sequence
  synthesized
gagagauggaaagagaagcc

SEQ ID NO: 2070 - RNA, 20 nt, Artificial Sequence
  synthesized
gagagauggaaggagaagcc

SEQ ID NO: 2071 - RNA, 20 nt, Artificial Sequence
  synthesized
gagauggaaagagaagccug

SEQ ID NO: 2072 - RNA, 20 nt, Artificial Sequence
  synthesized
gagauggaaggagaagccug

SEQ ID NO: 2073 - RNA, 20 nt, Artificial Sequence
  synthesized
gcuucagagagauggaaaga

SEQ ID NO: 2074 - RNA, 20 nt, Artificial Sequence
  synthesized
gcuucagagagauggaagga

SEQ ID NO: 2075 - RNA, 20 nt, Artificial Sequence
  synthesized
ggcaggcuucuccuuccauc

SEQ ID NO: 2076 - RNA, 20 nt, Artificial Sequence
  synthesized
ggcaggcuucucuuuccauc

SEQ ID NO: 2077 - RNA, 20 nt, Artificial Sequence
  synthesized
uccuuccaucucucugaagc

SEQ ID NO: 2078 - RNA, 20 nt, Artificial Sequence
  synthesized
ucuccuuccaucucucugaa

SEQ ID NO: 2079 - RNA, 20 nt, Artificial Sequence
  synthesized
ucucuuuccaucucucugaa

SEQ ID NO: 2080 - RNA, 20 nt, Artificial Sequence
  synthesized
ucuuuccaucucucugaagc

SEQ ID NO: 2081 - RNA, 20 nt, Artificial Sequence
  synthesized
uggaaagagaagccugccgg

SEQ ID NO: 2082 - RNA, 20 nt, Artificial Sequence
  synthesized
uggaaggagaagccugccgg

SEQ ID NO: 2083 - RNA, 20 nt, Artificial Sequence
  synthesized
uucagagagauggaaagaga

SEQ ID NO: 2084 - RNA, 20 nt, Artificial Sequence
  synthesized
uucagagagauggaaggaga

SEQ ID NO: 2085 - RNA, 20 nt, Artificial Sequence
  synthesized
uugcuucagagagauggaaa

SEQ ID NO: 2086 - RNA, 20 nt, Artificial Sequence
  synthesized
uugcuucagagagauggaag

SEQ ID NO: 2087 - RNA, 20 nt, Artificial Sequence
  synthesized
uuuccaucucucugaagcaa

SEQ ID NO: 2088 - RNA, 20 nt, Artificial Sequence
  synthesized
auggugugugggaguggggg

SEQ ID NO: 2089 - RNA, 20 nt, Artificial Sequence
  synthesized
augguguguggggguggggg

SEQ ID NO: 2090 - RNA, 20 nt, Artificial Sequence
  synthesized
cacccccacacaccauuuuu

SEQ ID NO: 2091 - RNA, 20 nt, Artificial Sequence
  synthesized
cacucccacacaccauuuuu

SEQ ID NO: 2092 - RNA, 20 nt, Artificial Sequence
  synthesized
cccacccccacacaccauuu

SEQ ID NO: 2093 - RNA, 20 nt, Artificial Sequence
  synthesized
cccacucccacacaccauuu

SEQ ID NO: 2094 - RNA, 20 nt, Artificial Sequence
  synthesized
cccccacacaccauuuuugc

SEQ ID NO: 2095 - RNA, 20 nt, Artificial Sequence
  synthesized
cccccacccccacacaccau

SEQ ID NO: 2096 - RNA, 20 nt, Artificial Sequence
  synthesized
cccccacucccacacaccau

SEQ ID NO: 2097 - RNA, 20 nt, Artificial Sequence
  synthesized
ccccuugucccccaccccca

SEQ ID NO: 2098 - RNA, 20 nt, Artificial Sequence
  synthesized
ccccuugucccccacuccca

SEQ ID NO: 2099 - RNA, 20 nt, Artificial Sequence
  synthesized
cccuccccuugucccccacu

SEQ ID NO: 2100 - RNA, 20 nt, Artificial Sequence
  synthesized
ccuugucccccacccccaca

SEQ ID NO: 2101 - RNA, 20 nt, Artificial Sequence
  synthesized
ccuugucccccacucccaca

SEQ ID NO: 2102 - RNA, 20 nt, Artificial Sequence
  synthesized
cucccacacaccauuuuugc

SEQ ID NO: 2103 - RNA, 20 nt, Artificial Sequence
  synthesized
cuccccuugucccccacccc

SEQ ID NO: 2104 - RNA, 20 nt, Artificial Sequence
  synthesized
cuccccuugucccccacucc

SEQ ID NO: 2105 - RNA, 20 nt, Artificial Sequence
  synthesized
ggugugugggagugggggac

SEQ ID NO: 2106 - RNA, 20 nt, Artificial Sequence
  synthesized
ggugugugggggugggggac

SEQ ID NO: 2107 - RNA, 20 nt, Artificial Sequence
  synthesized
gucccccacccccacacacc

SEQ ID NO: 2108 - RNA, 20 nt, Artificial Sequence
  synthesized
gucccccacucccacacacc

SEQ ID NO: 2109 - RNA, 20 nt, Artificial Sequence
  synthesized
uugucccccacccccacaca

SEQ ID NO: 2110 - RNA, 20 nt, Artificial Sequence
  synthesized
uugucccccacucccacaca

SEQ ID NO: 2111 - RNA, 20 nt, Artificial Sequence
  synthesized
aacugacucucuauugcgac

SEQ ID NO: 2112 - RNA, 20 nt, Artificial Sequence
  synthesized
aacugacucuguauugcgac

SEQ ID NO: 2113 - RNA, 20 nt, Artificial Sequence
  synthesized
acagagucaguuucucaaac

SEQ ID NO: 2114 - RNA, 20 nt, Artificial Sequence
  synthesized
agagagucaguuucucaaac

SEQ ID NO: 2115 - RNA, 20 nt, Artificial Sequence
  synthesized
agcugucgcaauacagaguc

SEQ ID NO: 2116 - RNA, 20 nt, Artificial Sequence
  synthesized
agcugucgcaauagagaguc

SEQ ID NO: 2117 - RNA, 20 nt, Artificial Sequence
  synthesized
auacagagucaguuucucaa

SEQ ID NO: 2118 - RNA, 20 nt, Artificial Sequence
  synthesized
auagagagucaguuucucaa

SEQ ID NO: 2119 - RNA, 20 nt, Artificial Sequence
  synthesized
auguagcugucgcaauacag

SEQ ID NO: 2120 - RNA, 20 nt, Artificial Sequence
  synthesized
auguagcugucgcaauagag

SEQ ID NO: 2121 - RNA, 20 nt, Artificial Sequence
  synthesized
cuauugcgacagcuacaucc

SEQ ID NO: 2122 - RNA, 20 nt, Artificial Sequence
  synthesized
cucuauugcgacagcuacau

SEQ ID NO: 2123 - RNA, 20 nt, Artificial Sequence
  synthesized
cucucuauugcgacagcuac

SEQ ID NO: 2124 - RNA, 20 nt, Artificial Sequence
  synthesized
cugucgcaauacagagucag

SEQ ID NO: 2125 - RNA, 20 nt, Artificial Sequence
  synthesized
cugucgcaauagagagucag

SEQ ID NO: 2126 - RNA, 20 nt, Artificial Sequence
  synthesized
gaaacugacucucuauugcg

SEQ ID NO: 2127 - RNA, 20 nt, Artificial Sequence
  synthesized
gaaacugacucuguauugcg

SEQ ID NO: 2128 - RNA, 20 nt, Artificial Sequence
  synthesized
gacucucuauugcgacagcu

SEQ ID NO: 2129 - RNA, 20 nt, Artificial Sequence
  synthesized
gacucuguauugcgacagcu

SEQ ID NO: 2130 - RNA, 20 nt, Artificial Sequence
  synthesized
guagcugucgcaauacagag

SEQ ID NO: 2131 - RNA, 20 nt, Artificial Sequence
  synthesized
guagcugucgcaauagagag

SEQ ID NO: 2132 - RNA, 20 nt, Artificial Sequence
  synthesized
gucgcaauacagagucaguu

SEQ ID NO: 2133 - RNA, 20 nt, Artificial Sequence
  synthesized
gucgcaauagagagucaguu

SEQ ID NO: 2134 - RNA, 20 nt, Artificial Sequence
  synthesized
guuugagaaacugacucucu

SEQ ID NO: 2135 - RNA, 20 nt, Artificial Sequence
  synthesized
guuugagaaacugacucugu

SEQ ID NO: 2136 - RNA, 20 nt, Artificial Sequence
  synthesized
aaggaagcagcuggggaggg

SEQ ID NO: 2137 - RNA, 20 nt, Artificial Sequence
  synthesized
agcuggggagggaagggcuc

SEQ ID NO: 2138 - RNA, 20 nt, Artificial Sequence
  synthesized
agggaagggcucaccuagag

SEQ ID NO: 2139 - RNA, 20 nt, Artificial Sequence
  synthesized
aggugagcccuucccucccc

SEQ ID NO: 2140 - RNA, 20 nt, Artificial Sequence
  synthesized
cccuccccagcugcuuccuu

SEQ ID NO: 2141 - RNA, 20 nt, Artificial Sequence
  synthesized
ccuucccuccccagcugcuu

SEQ ID NO: 2142 - RNA, 20 nt, Artificial Sequence
  synthesized
cuaggugagcccuucccucc

SEQ ID NO: 2143 - RNA, 20 nt, Artificial Sequence
  synthesized
cuccccagcugcuuccuugg

SEQ ID NO: 2144 - RNA, 20 nt, Artificial Sequence
  synthesized
cucuaggugagcccuucccu

SEQ ID NO: 2145 - RNA, 20 nt, Artificial Sequence
  synthesized
cuggggagggaagggcucac

SEQ ID NO: 2146 - RNA, 20 nt, Artificial Sequence
  synthesized
gagcccuucccuccccagcu

SEQ ID NO: 2147 - RNA, 20 nt, Artificial Sequence
  synthesized
gcagcuggggagggaagggc

SEQ ID NO: 2148 - RNA, 20 nt, Artificial Sequence
  synthesized
gcccuucccuccccagcugc

SEQ ID NO: 2149 - RNA, 20 nt, Artificial Sequence
  synthesized
gugagcccuucccuccccag

SEQ ID NO: 2150 - RNA, 20 nt, Artificial Sequence
  synthesized
ugggaagggcucaccuagag

SEQ ID NO: 2151 - RNA, 20 nt, Artificial Sequence
  synthesized
uucccuccccagcugcuucc

SEQ ID NO: 2152 - RNA, 20 nt, Artificial Sequence
  synthesized
aggugagcccuucccacuag

SEQ ID NO: 2153 - RNA, 20 nt, Artificial Sequence
  synthesized
aggugcccagcugcuuccuu

SEQ ID NO: 2154 - RNA, 20 nt, Artificial Sequence
  synthesized
cacuaggugcccagcugcuu

SEQ ID NO: 2155 - RNA, 20 nt, Artificial Sequence
  synthesized
ccaaggaagcagcugggcac

SEQ ID NO: 2156 - RNA, 20 nt, Artificial Sequence
  synthesized
cccacuaggugcccagcugc

SEQ ID NO: 2157 - RNA, 20 nt, Artificial Sequence
  synthesized
ccccagcugcuuccuugguc

SEQ ID NO: 2158 - RNA, 20 nt, Artificial Sequence
  synthesized
ccuucccacuaggugcccag

SEQ ID NO: 2159 - RNA, 20 nt, Artificial Sequence
  synthesized
cuaggugcccagcugcuucc

SEQ ID NO: 2160 - RNA, 20 nt, Artificial Sequence
  synthesized
gaccaaggaagcagcugggc

SEQ ID NO: 2161 - RNA, 20 nt, Artificial Sequence
  synthesized
gagcccuucccacuaggugc

SEQ ID NO: 2162 - RNA, 20 nt, Artificial Sequence
  synthesized
gcaccuagugggaagggcuc

SEQ ID NO: 2163 - RNA, 20 nt, Artificial Sequence
  synthesized
gcagcugggcaccuaguggg

SEQ ID NO: 2164 - RNA, 20 nt, Artificial Sequence
  synthesized
gcccagcugcuuccuugguc

SEQ ID NO: 2165 - RNA, 20 nt, Artificial Sequence
  synthesized
gcccuucccacuaggugccc

SEQ ID NO: 2166 - RNA, 20 nt, Artificial Sequence
  synthesized
gggcaccuagugggaagggc

SEQ ID NO: 2167 - RNA, 20 nt, Artificial Sequence
  synthesized
gugagcccuucccacuaggu

SEQ ID NO: 2168 - RNA, 20 nt, Artificial Sequence
  synthesized
gugcccagcugcuuccuugg

SEQ ID NO: 2169 - RNA, 20 nt, Artificial Sequence
  synthesized
uucccacuaggugcccagcu

SEQ ID NO: 2170 - RNA, 20 nt, Artificial Sequence
  synthesized
acuuaagcccaggaguuuag

SEQ ID NO: 2171 - RNA, 20 nt, Artificial Sequence
  synthesized
gguccuaaacuccugggcuu

SEQ ID NO: 2172 - RNA, 20 nt, Artificial Sequence
  synthesized
uuaagcccaggaguuuagga

SEQ ID NO: 2173 - RNA, 20 nt, Artificial Sequence
  synthesized
agccucgaccucacaggcuu

SEQ ID NO: 2174 - RNA, 20 nt, Artificial Sequence
  synthesized
agccuugaccucacaggcuu

SEQ ID NO: 2175 - RNA, 20 nt, Artificial Sequence
  synthesized
ccucgaccucacaggcuuca

SEQ ID NO: 2176 - RNA, 20 nt, Artificial Sequence
  synthesized
ccuugaccucacaggcuuca

SEQ ID NO: 2177 - RNA, 20 nt, Artificial Sequence
  synthesized
gcugaagccugugaggucaa

SEQ ID NO: 2178 - RNA, 20 nt, Artificial Sequence
  synthesized
gcugaagccugugaggucga

SEQ ID NO: 2179 - RNA, 20 nt, Artificial Sequence
  synthesized
ucgaccucacaggcuucagc

SEQ ID NO: 2180 - RNA, 20 nt, Artificial Sequence
  synthesized
ugaagccugugaggucaagg

SEQ ID NO: 2181 - RNA, 20 nt, Artificial Sequence
  synthesized
ugaagccugugaggucgagg

SEQ ID NO: 2182 - RNA, 20 nt, Artificial Sequence
  synthesized
uugaccucacaggcuucagc

SEQ ID NO: 2183 - RNA, 20 nt, Artificial Sequence
  synthesized
cagccucccaaagugcuggg

SEQ ID NO: 2184 - RNA, 20 nt, Artificial Sequence
  synthesized
uaaucccagcacuuugggag

SEQ ID NO: 2185 - RNA, 20 nt, Artificial Sequence
  synthesized
aauaagcccgagccacagcc

SEQ ID NO: 2186 - RNA, 20 nt, Artificial Sequence
  synthesized
aauaagccugagccacagcc

SEQ ID NO: 2187 - RNA, 20 nt, Artificial Sequence
  synthesized
agcccgagccacagcccccc

SEQ ID NO: 2188 - RNA, 20 nt, Artificial Sequence
  synthesized
agccugagccacagcccccc

SEQ ID NO: 2189 - RNA, 20 nt, Artificial Sequence
  synthesized
caggcuuauuccaguacaug

SEQ ID NO: 2190 - RNA, 20 nt, Artificial Sequence
  synthesized
cccgagccacagccccccua

SEQ ID NO: 2191 - RNA, 20 nt, Artificial Sequence
  synthesized
ccugagccacagccccccua

SEQ ID NO: 2192 - RNA, 20 nt, Artificial Sequence
  synthesized
cgagccacagccccccuaca

SEQ ID NO: 2193 - RNA, 20 nt, Artificial Sequence
  synthesized
cgggcuuauuccaguacaug

SEQ ID NO: 2194 - RNA, 20 nt, Artificial Sequence
  synthesized
cucaggcuuauuccaguaca

SEQ ID NO: 2195 - RNA, 20 nt, Artificial Sequence
  synthesized
cucgggcuuauuccaguaca

SEQ ID NO: 2196 - RNA, 20 nt, Artificial Sequence
  synthesized
cuggaauaagcccgagccac

SEQ ID NO: 2197 - RNA, 20 nt, Artificial Sequence
  synthesized
cuggaauaagccugagccac

SEQ ID NO: 2198 - RNA, 20 nt, Artificial Sequence
  synthesized
cuguggcucaggcuuauucc

SEQ ID NO: 2199 - RNA, 20 nt, Artificial Sequence
  synthesized
cuguggcucgggcuuauucc

SEQ ID NO: 2200 - RNA, 20 nt, Artificial Sequence
  synthesized
ggaauaagcccgagccacag

SEQ ID NO: 2201 - RNA, 20 nt, Artificial Sequence
  synthesized
ggaauaagccugagccacag

SEQ ID NO: 2202 - RNA, 20 nt, Artificial Sequence
  synthesized
ggcucaggcuuauuccagua

SEQ ID NO: 2203 - RNA, 20 nt, Artificial Sequence
  synthesized
ggcucgggcuuauuccagua

SEQ ID NO: 2204 - RNA, 20 nt, Artificial Sequence
  synthesized
ggcuguggcucaggcuuauu

SEQ ID NO: 2205 - RNA, 20 nt, Artificial Sequence
  synthesized
ggcuguggcucgggcuuauu

SEQ ID NO: 2206 - RNA, 20 nt, Artificial Sequence
  synthesized
ggggcuguggcucaggcuua

SEQ ID NO: 2207 - RNA, 20 nt, Artificial Sequence
  synthesized
ggggcuguggcucgggcuua

SEQ ID NO: 2208 - RNA, 20 nt, Artificial Sequence
  synthesized
ggggggcuguggcucaggcu

SEQ ID NO: 2209 - RNA, 20 nt, Artificial Sequence
  synthesized
ggggggcuguggcucgggcu

SEQ ID NO: 2210 - RNA, 20 nt, Artificial Sequence
  synthesized
guggcucaggcuuauuccag

SEQ ID NO: 2211 - RNA, 20 nt, Artificial Sequence
  synthesized
guggcucgggcuuauuccag

SEQ ID NO: 2212 - RNA, 20 nt, Artificial Sequence
  synthesized
uaagcccgagccacagcccc

SEQ ID NO: 2213 - RNA, 20 nt, Artificial Sequence
  synthesized
uaagccugagccacagcccc

SEQ ID NO: 2214 - RNA, 20 nt, Artificial Sequence
  synthesized
uacuggaauaagcccgagcc

SEQ ID NO: 2215 - RNA, 20 nt, Artificial Sequence
  synthesized
uacuggaauaagccugagcc

SEQ ID NO: 2216 - RNA, 20 nt, Artificial Sequence
  synthesized
uaggggggcuguggcucagg

SEQ ID NO: 2217 - RNA, 20 nt, Artificial Sequence
  synthesized
uaggggggcuguggcucggg

SEQ ID NO: 2218 - RNA, 20 nt, Artificial Sequence
  synthesized
ugagccacagccccccuaca

SEQ ID NO: 2219 - RNA, 20 nt, Artificial Sequence
  synthesized
uguacuggaauaagcccgag

SEQ ID NO: 2220 - RNA, 20 nt, Artificial Sequence
  synthesized
uguacuggaauaagccugag

SEQ ID NO: 2221 - RNA, 20 nt, Artificial Sequence
  synthesized
uguaggggggcuguggcuca

SEQ ID NO: 2222 - RNA, 20 nt, Artificial Sequence
  synthesized
uguaggggggcuguggcucg

SEQ ID NO: 2223 - RNA, 20 nt, Artificial Sequence
  synthesized
aacauaguucuggaugacaa

SEQ ID NO: 2224 - RNA, 20 nt, Artificial Sequence
  synthesized
aacauaguuguggaugacaa

SEQ ID NO: 2225 - RNA, 20 nt, Artificial Sequence
  synthesized
agaaaacauaguucuggaug

SEQ ID NO: 2226 - RNA, 20 nt, Artificial Sequence
  synthesized
agaaaacauaguuguggaug

SEQ ID NO: 2227 - RNA, 20 nt, Artificial Sequence
  synthesized
cacaacuauguuuucuuuuc

SEQ ID NO: 2228 - RNA, 20 nt, Artificial Sequence
  synthesized
cagaacuauguuuucuuuuc

SEQ ID NO: 2229 - RNA, 20 nt, Artificial Sequence
  synthesized
cauaguucuggaugacaaga

SEQ ID NO: 2230 - RNA, 20 nt, Artificial Sequence
  synthesized
cauaguuguggaugacaaga

SEQ ID NO: 2231 - RNA, 20 nt, Artificial Sequence
  synthesized
cauccacaacuauguuuucu

SEQ ID NO: 2232 - RNA, 20 nt, Artificial Sequence
  synthesized
cauccagaacuauguuuucu

SEQ ID NO: 2233 - RNA, 20 nt, Artificial Sequence
  synthesized
ccuggcucuugucauccaca

SEQ ID NO: 2234 - RNA, 20 nt, Artificial Sequence
  synthesized
ccuggcucuugucauccaga

SEQ ID NO: 2235 - RNA, 20 nt, Artificial Sequence
  synthesized
gcucuugucauccacaacua

SEQ ID NO: 2236 - RNA, 20 nt, Artificial Sequence
  synthesized
gcucuugucauccagaacua

SEQ ID NO: 2237 - RNA, 20 nt, Artificial Sequence
  synthesized
gucauccacaacuauguuuu

SEQ ID NO: 2238 - RNA, 20 nt, Artificial Sequence
  synthesized
gucauccagaacuauguuuu

SEQ ID NO: 2239 - RNA, 20 nt, Artificial Sequence
  synthesized
guucuggaugacaagagcca

SEQ ID NO: 2240 - RNA, 20 nt, Artificial Sequence
  synthesized
guuguggaugacaagagcca

SEQ ID NO: 2241 - RNA, 20 nt, Artificial Sequence
  synthesized
uaguucuggaugacaagagc

SEQ ID NO: 2242 - RNA, 20 nt, Artificial Sequence
  synthesized
uaguuguggaugacaagagc

SEQ ID NO: 2243 - RNA, 20 nt, Artificial Sequence
  synthesized
uccacaacuauguuuucuuu

SEQ ID NO: 2244 - RNA, 20 nt, Artificial Sequence
  synthesized
uccagaacuauguuuucuuu

SEQ ID NO: 2245 - RNA, 20 nt, Artificial Sequence
  synthesized
ucuggaugacaagagccagg

SEQ ID NO: 2246 - RNA, 20 nt, Artificial Sequence
  synthesized
ucuugucauccacaacuaug

SEQ ID NO: 2247 - RNA, 20 nt, Artificial Sequence
  synthesized
ucuugucauccagaacuaug

SEQ ID NO: 2248 - RNA, 20 nt, Artificial Sequence
  synthesized
uggcucuugucauccacaac

SEQ ID NO: 2249 - RNA, 20 nt, Artificial Sequence
  synthesized
uggcucuugucauccagaac

SEQ ID NO: 2250 - RNA, 20 nt, Artificial Sequence
  synthesized
uguggaugacaagagccagg

SEQ ID NO: 2251 - RNA, 20 nt, Artificial Sequence
  synthesized
uugucauccacaacuauguu

SEQ ID NO: 2252 - RNA, 20 nt, Artificial Sequence
  synthesized
uugucauccagaacuauguu

SEQ ID NO: 2253 - RNA, 20 nt, Artificial Sequence
  synthesized
aacgcaagaaagugagccca

SEQ ID NO: 2254 - RNA, 20 nt, Artificial Sequence
  synthesized
aacgcgagaaagugagccca

SEQ ID NO: 2255 - RNA, 20 nt, Artificial Sequence
  synthesized
aguagaaacgcaagaaagug

SEQ ID NO: 2256 - RNA, 20 nt, Artificial Sequence
  synthesized
aguagaaacgcgagaaagug

SEQ ID NO: 2257 - RNA, 20 nt, Artificial Sequence
  synthesized
caagaaagugagcccagagg

SEQ ID NO: 2258 - RNA, 20 nt, Artificial Sequence
  synthesized
cacuuucucgcguuucuacu

SEQ ID NO: 2259 - RNA, 20 nt, Artificial Sequence
  synthesized
cacuuucuugcguuucuacu

SEQ ID NO: 2260 - RNA, 20 nt, Artificial Sequence
  synthesized
ccucugggcucacuuucucg

SEQ ID NO: 2261 - RNA, 20 nt, Artificial Sequence
  synthesized
ccucugggcucacuuucuug

SEQ ID NO: 2262 - RNA, 20 nt, Artificial Sequence
  synthesized
cgagaaagugagcccagagg

SEQ ID NO: 2263 - RNA, 20 nt, Artificial Sequence
  synthesized
cgcaagaaagugagcccaga

SEQ ID NO: 2264 - RNA, 20 nt, Artificial Sequence
  synthesized
cgcgagaaagugagcccaga

SEQ ID NO: 2265 - RNA, 20 nt, Artificial Sequence
  synthesized
cgcguuucuacuuccaaaag

SEQ ID NO: 2266 - RNA, 20 nt, Artificial Sequence
  synthesized
cucacuuucucgcguuucua

SEQ ID NO: 2267 - RNA, 20 nt, Artificial Sequence
  synthesized
cucacuuucuugcguuucua

SEQ ID NO: 2268 - RNA, 20 nt, Artificial Sequence
  synthesized
cuuucucgcguuucuacuuc

SEQ ID NO: 2269 - RNA, 20 nt, Artificial Sequence
  synthesized
cuuucuugcguuucuacuuc

SEQ ID NO: 2270 - RNA, 20 nt, Artificial Sequence
  synthesized
gaaacgcaagaaagugagcc

SEQ ID NO: 2271 - RNA, 20 nt, Artificial Sequence
  synthesized
gaaacgcgagaaagugagcc

SEQ ID NO: 2272 - RNA, 20 nt, Artificial Sequence
  synthesized
ggcucacuuucucgcguuuc

SEQ ID NO: 2273 - RNA, 20 nt, Artificial Sequence
  synthesized
ggcucacuuucuugcguuuc

SEQ ID NO: 2274 - RNA, 20 nt, Artificial Sequence
  synthesized
uagaaacgcaagaaagugag

SEQ ID NO: 2275 - RNA, 20 nt, Artificial Sequence
  synthesized
uagaaacgcgagaaagugag

SEQ ID NO: 2276 - RNA, 20 nt, Artificial Sequence
  synthesized
ucugggcucacuuucucgcg

SEQ ID NO: 2277 - RNA, 20 nt, Artificial Sequence
  synthesized
ucugggcucacuuucuugcg

SEQ ID NO: 2278 - RNA, 20 nt, Artificial Sequence
  synthesized
ugcguuucuacuuccaaaag

SEQ ID NO: 2279 - RNA, 20 nt, Artificial Sequence
  synthesized
ugggcucacuuucucgcguu

SEQ ID NO: 2280 - RNA, 20 nt, Artificial Sequence
  synthesized
ugggcucacuuucuugcguu

SEQ ID NO: 2281 - RNA, 20 nt, Artificial Sequence
  synthesized
uuuggaaguagaaacgcaag

SEQ ID NO: 2282 - RNA, 20 nt, Artificial Sequence
  synthesized
uuuggaaguagaaacgcgag

SEQ ID NO: 2283 - RNA, 20 nt, Artificial Sequence
  synthesized
aagacagccacaccuuagua

SEQ ID NO: 2284 - RNA, 20 nt, Artificial Sequence
  synthesized
aagacagcuacaccuuagua

SEQ ID NO: 2285 - RNA, 20 nt, Artificial Sequence
  synthesized
aguauacuaagguguagcug

SEQ ID NO: 2286 - RNA, 20 nt, Artificial Sequence
  synthesized
aguauacuaagguguggcug

SEQ ID NO: 2287 - RNA, 20 nt, Artificial Sequence
  synthesized
auccaagacagccacaccuu

SEQ ID NO: 2288 - RNA, 20 nt, Artificial Sequence
  synthesized
auccaagacagcuacaccuu

SEQ ID NO: 2289 - RNA, 20 nt, Artificial Sequence
  synthesized
aucugaauccaagacagcca

SEQ ID NO: 2290 - RNA, 20 nt, Artificial Sequence
  synthesized
aucugaauccaagacagcua

SEQ ID NO: 2291 - RNA, 20 nt, Artificial Sequence
  synthesized
cacaccuuaguauacugccc

SEQ ID NO: 2292 - RNA, 20 nt, Artificial Sequence
  synthesized
cagccacaccuuaguauacu

SEQ ID NO: 2293 - RNA, 20 nt, Artificial Sequence
  synthesized
cagcuacaccuuaguauacu

SEQ ID NO: 2294 - RNA, 20 nt, Artificial Sequence
  synthesized
ccaagacagccacaccuuag

SEQ ID NO: 2295 - RNA, 20 nt, Artificial Sequence
  synthesized
ccaagacagcuacaccuuag

SEQ ID NO: 2296 - RNA, 20 nt, Artificial Sequence
  synthesized
cuaagguguagcugucuugg

SEQ ID NO: 2297 - RNA, 20 nt, Artificial Sequence
  synthesized
cuaagguguggcugucuugg

SEQ ID NO: 2298 - RNA, 20 nt, Artificial Sequence
  synthesized
cugaauccaagacagccaca

SEQ ID NO: 2299 - RNA, 20 nt, Artificial Sequence
  synthesized
cugaauccaagacagcuaca

SEQ ID NO: 2300 - RNA, 20 nt, Artificial Sequence
  synthesized
gaauccaagacagccacacc

SEQ ID NO: 2301 - RNA, 20 nt, Artificial Sequence
  synthesized
gaauccaagacagcuacacc

SEQ ID NO: 2302 - RNA, 20 nt, Artificial Sequence
  synthesized
gacagccacaccuuaguaua

SEQ ID NO: 2303 - RNA, 20 nt, Artificial Sequence
  synthesized
gacagcuacaccuuaguaua

SEQ ID NO: 2304 - RNA, 20 nt, Artificial Sequence
  synthesized
gcaguauacuaagguguagc

SEQ ID NO: 2305 - RNA, 20 nt, Artificial Sequence
  synthesized
gcaguauacuaagguguggc

SEQ ID NO: 2306 - RNA, 20 nt, Artificial Sequence
  synthesized
gccacaccuuaguauacugc

SEQ ID NO: 2307 - RNA, 20 nt, Artificial Sequence
  synthesized
gcuacaccuuaguauacugc

SEQ ID NO: 2308 - RNA, 20 nt, Artificial Sequence
  synthesized
gggcaguauacuaaggugua

SEQ ID NO: 2309 - RNA, 20 nt, Artificial Sequence
  synthesized
gggcaguauacuaaggugug

SEQ ID NO: 2310 - RNA, 20 nt, Artificial Sequence
  synthesized
uacaccuuaguauacugccc

SEQ ID NO: 2311 - RNA, 20 nt, Artificial Sequence
  synthesized
uauacuaagguguagcuguc

SEQ ID NO: 2312 - RNA, 20 nt, Artificial Sequence
  synthesized
uauacuaagguguggcuguc

SEQ ID NO: 2313 - RNA, 20 nt, Artificial Sequence
  synthesized
uguagcugucuuggauucag

SEQ ID NO: 2314 - RNA, 20 nt, Artificial Sequence
  synthesized
uguggcugucuuggauucag

SEQ ID NO: 2315 - RNA, 20 nt, Artificial Sequence
  synthesized
aagcuacgaugcuuggaugg

SEQ ID NO: 2316 - RNA, 20 nt, Artificial Sequence
  synthesized
aagcuaugaugcuuggaugg

SEQ ID NO: 2317 - RNA, 20 nt, Artificial Sequence
  synthesized
aucauagcuuaucagaaaac

SEQ ID NO: 2318 - RNA, 20 nt, Artificial Sequence
  synthesized
auccaagcaucauagcuuau

SEQ ID NO: 2319 - RNA, 20 nt, Artificial Sequence
  synthesized
auccaagcaucguagcuuau

SEQ ID NO: 2320 - RNA, 20 nt, Artificial Sequence
  synthesized
aucguagcuuaucagaaaac

SEQ ID NO: 2321 - RNA, 20 nt, Artificial Sequence
  synthesized
auguuuucugauaagcuacg

SEQ ID NO: 2322 - RNA, 20 nt, Artificial Sequence
  synthesized
auguuuucugauaagcuaug

SEQ ID NO: 2323 - RNA, 20 nt, Artificial Sequence
  synthesized
cacuucccauccaagcauca

SEQ ID NO: 2324 - RNA, 20 nt, Artificial Sequence
  synthesized
cacuucccauccaagcaucg

SEQ ID NO: 2325 - RNA, 20 nt, Artificial Sequence
  synthesized
cauagcuuaucagaaaacau

SEQ ID NO: 2326 - RNA, 20 nt, Artificial Sequence
  synthesized
ccauccaagcaucauagcuu

SEQ ID NO: 2327 - RNA, 20 nt, Artificial Sequence
  synthesized
ccauccaagcaucguagcuu

SEQ ID NO: 2328 - RNA, 20 nt, Artificial Sequence
  synthesized
cgaugcuuggaugggaagug

SEQ ID NO: 2329 - RNA, 20 nt, Artificial Sequence
  synthesized
cguagcuuaucagaaaacau

SEQ ID NO: 2330 - RNA, 20 nt, Artificial Sequence
  synthesized
cuucccauccaagcaucaua

SEQ ID NO: 2331 - RNA, 20 nt, Artificial Sequence
  synthesized
cuucccauccaagcaucgua

SEQ ID NO: 2332 - RNA, 20 nt, Artificial Sequence
  synthesized
gcaucauagcuuaucagaaa

SEQ ID NO: 2333 - RNA, 20 nt, Artificial Sequence
  synthesized
gcaucguagcuuaucagaaa

SEQ ID NO: 2334 - RNA, 20 nt, Artificial Sequence
  synthesized
guuuucugauaagcuacgau

SEQ ID NO: 2335 - RNA, 20 nt, Artificial Sequence
  synthesized
guuuucugauaagcuaugau

SEQ ID NO: 2336 - RNA, 20 nt, Artificial Sequence
  synthesized
ucccauccaagcaucauagc

SEQ ID NO: 2337 - RNA, 20 nt, Artificial Sequence
  synthesized
ucccauccaagcaucguagc

SEQ ID NO: 2338 - RNA, 20 nt, Artificial Sequence
  synthesized
ugauaagcuacgaugcuugg

SEQ ID NO: 2339 - RNA, 20 nt, Artificial Sequence
  synthesized
ugauaagcuaugaugcuugg

SEQ ID NO: 2340 - RNA, 20 nt, Artificial Sequence
  synthesized
ugaugcuuggaugggaagug

SEQ ID NO: 2341 - RNA, 20 nt, Artificial Sequence
  synthesized
uuucugauaagcuacgaugc

SEQ ID NO: 2342 - RNA, 20 nt, Artificial Sequence
  synthesized
uuucugauaagcuaugaugc

SEQ ID NO: 2343 - RNA, 20 nt, Artificial Sequence
  synthesized
aaauuucucuuuguggaugu

SEQ ID NO: 2344 - RNA, 20 nt, Artificial Sequence
  synthesized
acaaagagaaauuugacuuc

SEQ ID NO: 2345 - RNA, 20 nt, Artificial Sequence
  synthesized
acauccacaaagagaaauuu

SEQ ID NO: 2346 - RNA, 20 nt, Artificial Sequence
  synthesized
agagaaauuugacuuccuag

SEQ ID NO: 2347 - RNA, 20 nt, Artificial Sequence
  synthesized
agauaaauuugacuuccuag

SEQ ID NO: 2348 - RNA, 20 nt, Artificial Sequence
  synthesized
aggaagucaaauuucucuuu

SEQ ID NO: 2349 - RNA, 20 nt, Artificial Sequence
  synthesized
agucaaauuuaucuuugugg

SEQ ID NO: 2350 - RNA, 20 nt, Artificial Sequence
  synthesized
agucaaauuucucuuugugg

SEQ ID NO: 2351 - RNA, 20 nt, Artificial Sequence
  synthesized
agugacauccacaaagagaa

SEQ ID NO: 2352 - RNA, 20 nt, Artificial Sequence
  synthesized
agugacauccacaaagauaa

SEQ ID NO: 2353 - RNA, 20 nt, Artificial Sequence
  synthesized
auccacaaagagaaauuuga

SEQ ID NO: 2354 - RNA, 20 nt, Artificial Sequence
  synthesized
aucuuuguggaugucacucc

SEQ ID NO: 2355 - RNA, 20 nt, Artificial Sequence
  synthesized
auuuaucuuuguggauguca

SEQ ID NO: 2356 - RNA, 20 nt, Artificial Sequence
  synthesized
auuucucuuuguggauguca

SEQ ID NO: 2357 - RNA, 20 nt, Artificial Sequence
  synthesized
ccacaaagagaaauuugacu

SEQ ID NO: 2358 - RNA, 20 nt, Artificial Sequence
  synthesized
ccacaaagauaaauuugacu

SEQ ID NO: 2359 - RNA, 20 nt, Artificial Sequence
  synthesized
cuaggaagucaaauuuaucu

SEQ ID NO: 2360 - RNA, 20 nt, Artificial Sequence
  synthesized
cuaggaagucaaauuucucu

SEQ ID NO: 2361 - RNA, 20 nt, Artificial Sequence
  synthesized
cucuuuguggaugucacucc

SEQ ID NO: 2362 - RNA, 20 nt, Artificial Sequence
  synthesized
ggagugacauccacaaagag

SEQ ID NO: 2363 - RNA, 20 nt, Artificial Sequence
  synthesized
ggagugacauccacaaagau

SEQ ID NO: 2364 - RNA, 20 nt, Artificial Sequence
  synthesized
ucaaauuucucuuuguggau

SEQ ID NO: 2365 - RNA, 20 nt, Artificial Sequence
  synthesized
ugacauccacaaagagaaau

SEQ ID NO: 2366 - RNA, 20 nt, Artificial Sequence
  synthesized
ugacauccacaaagauaaau

SEQ ID NO: 2367 - RNA, 20 nt, Artificial Sequence
  synthesized
ugcuaggaagucaaauuuau

SEQ ID NO: 2368 - RNA, 20 nt, Artificial Sequence
  synthesized
ugcuaggaagucaaauuucu

SEQ ID NO: 2369 - RNA, 20 nt, Artificial Sequence
  synthesized
uuaucuuuguggaugucacu

SEQ ID NO: 2370 - RNA, 20 nt, Artificial Sequence
  synthesized
uucucuuuguggaugucacu

SEQ ID NO: 2371 - RNA, 20 nt, Artificial Sequence
  synthesized
aacauagcuaccaaauggug

SEQ ID NO: 2372 - RNA, 20 nt, Artificial Sequence
  synthesized
aaguuguccaaggcaacaua

SEQ ID NO: 2373 - RNA, 20 nt, Artificial Sequence
  synthesized
aaguuguccaaggccacaua

SEQ ID NO: 2374 - RNA, 20 nt, Artificial Sequence
  synthesized
caaggcaacauagcuaccaa

SEQ ID NO: 2375 - RNA, 20 nt, Artificial Sequence
  synthesized
cacauagcuaccaaauggug

SEQ ID NO: 2376 - RNA, 20 nt, Artificial Sequence
  synthesized
caccauuugguagcuaugug

SEQ ID NO: 2377 - RNA, 20 nt, Artificial Sequence
  synthesized
caccauuugguagcuauguu

SEQ ID NO: 2378 - RNA, 20 nt, Artificial Sequence
  synthesized
ccauuugguagcuauguugc

SEQ ID NO: 2379 - RNA, 20 nt, Artificial Sequence
  synthesized
gaguaaguuguccaaggcaa

SEQ ID NO: 2380 - RNA, 20 nt, Artificial Sequence
  synthesized
gaguaaguuguccaaggcca

SEQ ID NO: 2381 - RNA, 20 nt, Artificial Sequence
  synthesized
gcaacauagcuaccaaaugg

SEQ ID NO: 2382 - RNA, 20 nt, Artificial Sequence
  synthesized
gccacauagcuaccaaaugg

SEQ ID NO: 2383 - RNA, 20 nt, Artificial Sequence
  synthesized
gcuauguggccuuggacaac

SEQ ID NO: 2384 - RNA, 20 nt, Artificial Sequence
  synthesized
gcuauguugccuuggacaac

SEQ ID NO: 2385 - RNA, 20 nt, Artificial Sequence
  synthesized
gguagcuauguggccuugga

SEQ ID NO: 2386 - RNA, 20 nt, Artificial Sequence
  synthesized
gguagcuauguugccuugga

SEQ ID NO: 2387 - RNA, 20 nt, Artificial Sequence
  synthesized
guaaguuguccaaggcaaca

SEQ ID NO: 2388 - RNA, 20 nt, Artificial Sequence
  synthesized
guaaguuguccaaggccaca

SEQ ID NO: 2389 - RNA, 20 nt, Artificial Sequence
  synthesized
guuguccaaggcaacauagc

SEQ ID NO: 2390 - RNA, 20 nt, Artificial Sequence
  synthesized
guuguccaaggccacauagc

SEQ ID NO: 2391 - RNA, 20 nt, Artificial Sequence
  synthesized
uagcuauguggccuuggaca

SEQ ID NO: 2392 - RNA, 20 nt, Artificial Sequence
  synthesized
uagcuauguugccuuggaca

SEQ ID NO: 2393 - RNA, 20 nt, Artificial Sequence
  synthesized
uauguggccuuggacaacuu

SEQ ID NO: 2394 - RNA, 20 nt, Artificial Sequence
  synthesized
uauguugccuuggacaacuu

SEQ ID NO: 2395 - RNA, 20 nt, Artificial Sequence
  synthesized
uccaaggcaacauagcuacc

SEQ ID NO: 2396 - RNA, 20 nt, Artificial Sequence
  synthesized
uccaaggccacauagcuacc

SEQ ID NO: 2397 - RNA, 20 nt, Artificial Sequence
  synthesized
uggccuuggacaacuuacuc

SEQ ID NO: 2398 - RNA, 20 nt, Artificial Sequence
  synthesized
uguccaaggcaacauagcua

SEQ ID NO: 2399 - RNA, 20 nt, Artificial Sequence
  synthesized
uguggccuuggacaacuuac

SEQ ID NO: 2400 - RNA, 20 nt, Artificial Sequence
  synthesized
uguugccuuggacaacuuac

SEQ ID NO: 2401 - RNA, 20 nt, Artificial Sequence
  synthesized
uugccuuggacaacuuacuc

SEQ ID NO: 2402 - RNA, 20 nt, Artificial Sequence
  synthesized
uugguagcuauguugccuug

SEQ ID NO: 2403 - RNA, 20 nt, Artificial Sequence
  synthesized
agcuacugcacuugaccaac

SEQ ID NO: 2404 - RNA, 20 nt, Artificial Sequence
  synthesized
cgcuacugcacuugaccaac

SEQ ID NO: 2405 - RNA, 20 nt, Artificial Sequence
  synthesized
gucaagugcaguagcgcaca

SEQ ID NO: 2406 - RNA, 20 nt, Artificial Sequence
  synthesized
guuggucaagugcaguagcg

SEQ ID NO: 2407 - RNA, 20 nt, Artificial Sequence
  synthesized
guuggucaagugcaguagcu

SEQ ID NO: 2408 - RNA, 20 nt, Artificial Sequence
  synthesized
ugagcuacugcacuugacca

SEQ ID NO: 2409 - RNA, 20 nt, Artificial Sequence
  synthesized
ugcgcuacugcacuugacca

SEQ ID NO: 2410 - RNA, 20 nt, Artificial Sequence
  synthesized
uggucaagugcaguagcgca

SEQ ID NO: 2411 - RNA, 20 nt, Artificial Sequence
  synthesized
ugugagcuacugcacuugac

SEQ ID NO: 2412 - RNA, 20 nt, Artificial Sequence
  synthesized
ugugcgcuacugcacuugac

SEQ ID NO: 2413 - RNA, 20 nt, Artificial Sequence
  synthesized
agaggcccaucccucuucuc

SEQ ID NO: 2414 - RNA, 20 nt, Artificial Sequence
  synthesized
agaggccccucccucuucuc

SEQ ID NO: 2415 - RNA, 20 nt, Artificial Sequence
  synthesized
aggcccaucccucuucucca

SEQ ID NO: 2416 - RNA, 20 nt, Artificial Sequence
  synthesized
aggccccucccucuucucca

SEQ ID NO: 2417 - RNA, 20 nt, Artificial Sequence
  synthesized
aggggccucugagaagggac

SEQ ID NO: 2418 - RNA, 20 nt, Artificial Sequence
  synthesized
augggccucugagaagggac

SEQ ID NO: 2419 - RNA, 20 nt, Artificial Sequence
  synthesized
cccuucucagaggcccaucc

SEQ ID NO: 2420 - RNA, 20 nt, Artificial Sequence
  synthesized
cccuucucagaggccccucc

SEQ ID NO: 2421 - RNA, 20 nt, Artificial Sequence
  synthesized
cuucucagaggcccaucccu

SEQ ID NO: 2422 - RNA, 20 nt, Artificial Sequence
  synthesized
cuucucagaggccccucccu

SEQ ID NO: 2423 - RNA, 20 nt, Artificial Sequence
  synthesized
cuuggagaagagggaggggc

SEQ ID NO: 2424 - RNA, 20 nt, Artificial Sequence
  synthesized
cuuggagaagagggaugggc

SEQ ID NO: 2425 - RNA, 20 nt, Artificial Sequence
  synthesized
gaagagggaggggccucuga

SEQ ID NO: 2426 - RNA, 20 nt, Artificial Sequence
  synthesized
gaagagggaugggccucuga

SEQ ID NO: 2427 - RNA, 20 nt, Artificial Sequence
  synthesized
gacuuggagaagagggaggg

SEQ ID NO: 2428 - RNA, 20 nt, Artificial Sequence
  synthesized
gacuuggagaagagggaugg

SEQ ID NO: 2429 - RNA, 20 nt, Artificial Sequence
  synthesized
gagaagagggaggggccucu

SEQ ID NO: 2430 - RNA, 20 nt, Artificial Sequence
  synthesized
gagaagagggaugggccucu

SEQ ID NO: 2431 - RNA, 20 nt, Artificial Sequence
  synthesized
gcccaucccucuucuccaag

SEQ ID NO: 2432 - RNA, 20 nt, Artificial Sequence
  synthesized
gccccucccucuucuccaag

SEQ ID NO: 2433 - RNA, 20 nt, Artificial Sequence
  synthesized
ggaggggccucugagaaggg

SEQ ID NO: 2434 - RNA, 20 nt, Artificial Sequence
  synthesized
ggaugggccucugagaaggg

SEQ ID NO: 2435 - RNA, 20 nt, Artificial Sequence
  synthesized
gucccuucucagaggcccau

SEQ ID NO: 2436 - RNA, 20 nt, Artificial Sequence
  synthesized
gucccuucucagaggccccu

SEQ ID NO: 2437 - RNA, 20 nt, Artificial Sequence
  synthesized
ucagaggcccaucccucuuc

SEQ ID NO: 2438 - RNA, 20 nt, Artificial Sequence
  synthesized
ucagaggccccucccucuuc

SEQ ID NO: 2439 - RNA, 20 nt, Artificial Sequence
  synthesized
ucucagaggcccaucccucu

SEQ ID NO: 2440 - RNA, 20 nt, Artificial Sequence
  synthesized
ucucagaggccccucccucu

SEQ ID NO: 2441 - RNA, 20 nt, Artificial Sequence
  synthesized
uggagaagagggaggggccu

SEQ ID NO: 2442 - RNA, 20 nt, Artificial Sequence
  synthesized
uggagaagagggaugggccu

SEQ ID NO: 2443 - RNA, 20 nt, Artificial Sequence
  synthesized
acccuccggagaguaggagu

SEQ ID NO: 2444 - RNA, 20 nt, Artificial Sequence
  synthesized
acucuccggagggugggcuc

SEQ ID NO: 2445 - RNA, 20 nt, Artificial Sequence
  synthesized
agacuccuacucuccggagg

SEQ ID NO: 2446 - RNA, 20 nt, Artificial Sequence
  synthesized
aggagcccacccuccgagag

SEQ ID NO: 2447 - RNA, 20 nt, Artificial Sequence
  synthesized
aggagcccacccuccggaga

SEQ ID NO: 2448 - RNA, 20 nt, Artificial Sequence
  synthesized
cagacuccuacucucggagg

SEQ ID NO: 2449 - RNA, 20 nt, Artificial Sequence
  synthesized
ccacccuccgagaguaggag

SEQ ID NO: 2450 - RNA, 20 nt, Artificial Sequence
  synthesized
ccacccuccggagaguagga

SEQ ID NO: 2451 - RNA, 20 nt, Artificial Sequence
  synthesized
ccaggagcccacccuccgag

SEQ ID NO: 2452 - RNA, 20 nt, Artificial Sequence
  synthesized
ccaggagcccacccuccgga

SEQ ID NO: 2453 - RNA, 20 nt, Artificial Sequence
  synthesized
cccugccucagacuccuacu

SEQ ID NO: 2454 - RNA, 20 nt, Artificial Sequence
  synthesized
ccuacucucggagggugggc

SEQ ID NO: 2455 - RNA, 20 nt, Artificial Sequence
  synthesized
ccucagacuccuacucuccg

SEQ ID NO: 2456 - RNA, 20 nt, Artificial Sequence
  synthesized
ccuccggagaguaggagucu

SEQ ID NO: 2457 - RNA, 20 nt, Artificial Sequence
  synthesized
cggagaguaggagucugagg

SEQ ID NO: 2458 - RNA, 20 nt, Artificial Sequence
  synthesized
cuacucuccggagggugggc

SEQ ID NO: 2459 - RNA, 20 nt, Artificial Sequence
  synthesized
cuccuacucucggagggugg

SEQ ID NO: 2460 - RNA, 20 nt, Artificial Sequence
  synthesized
cucucggagggugggcuccu

SEQ ID NO: 2461 - RNA, 20 nt, Artificial Sequence
  synthesized
gcccacccuccgagaguagg

SEQ ID NO: 2462 - RNA, 20 nt, Artificial Sequence
  synthesized
gcccacccuccggagaguag

SEQ ID NO: 2463 - RNA, 20 nt, Artificial Sequence
  synthesized
gccucagacuccuacucucg

SEQ ID NO: 2464 - RNA, 20 nt, Artificial Sequence
  synthesized
uacucucggagggugggcuc

SEQ ID NO: 2465 - RNA, 20 nt, Artificial Sequence
  synthesized
uccgagaguaggagucugag

SEQ ID NO: 2466 - RNA, 20 nt, Artificial Sequence
  synthesized
uccggagaguaggagucuga

SEQ ID NO: 2467 - RNA, 20 nt, Artificial Sequence
  synthesized
uccuacucuccggagggugg

SEQ ID NO: 2468 - RNA, 20 nt, Artificial Sequence
  synthesized
ucuccggagggugggcuccu

SEQ ID NO: 2469 - RNA, 20 nt, Artificial Sequence
  synthesized
aacagcacuggauacccaug

SEQ ID NO: 2470 - RNA, 20 nt, Artificial Sequence
  synthesized
aagcgagaacagcacuggau

SEQ ID NO: 2471 - RNA, 20 nt, Artificial Sequence
  synthesized
aaggguuucuuccacgguau

SEQ ID NO: 2472 - RNA, 20 nt, Artificial Sequence
  synthesized
aaggguuucuuccaugggua

SEQ ID NO: 2473 - RNA, 20 nt, Artificial Sequence
  synthesized
accguggaagaaacccuuga

SEQ ID NO: 2474 - RNA, 20 nt, Artificial Sequence
  synthesized
acucaaggguuucuuccacg

SEQ ID NO: 2475 - RNA, 20 nt, Artificial Sequence
  synthesized
acucaaggguuucuuccaug

SEQ ID NO: 2476 - RNA, 20 nt, Artificial Sequence
  synthesized
acuggauacccauggaagaa

SEQ ID NO: 2477 - RNA, 20 nt, Artificial Sequence
  synthesized
agcacuggauaccguggaag

SEQ ID NO: 2478 - RNA, 20 nt, Artificial Sequence
  synthesized
auaccguggaagaaacccuu

SEQ ID NO: 2479 - RNA, 20 nt, Artificial Sequence
  synthesized
cacgguauccagugcuguuc

SEQ ID NO: 2480 - RNA, 20 nt, Artificial Sequence
  synthesized
cacuggauaccguggaagaa

SEQ ID NO: 2481 - RNA, 20 nt, Artificial Sequence
  synthesized
cauggguauccagugcuguu

SEQ ID NO: 2482 - RNA, 20 nt, Artificial Sequence
  synthesized
cccauggaagaaacccuuga

SEQ ID NO: 2483 - RNA, 20 nt, Artificial Sequence
  synthesized
cgguauccagugcuguucuc

SEQ ID NO: 2484 - RNA, 20 nt, Artificial Sequence
  synthesized
cuggauaccguggaagaaac

SEQ ID NO: 2485 - RNA, 20 nt, Artificial Sequence
  synthesized
cuuccacgguauccagugcu

SEQ ID NO: 2486 - RNA, 20 nt, Artificial Sequence
  synthesized
cuuccauggguauccagugc

SEQ ID NO: 2487 - RNA, 20 nt, Artificial Sequence
  synthesized
gaacagcacuggauaccgug

SEQ ID NO: 2488 - RNA, 20 nt, Artificial Sequence
  synthesized
gcacuggauacccauggaag

SEQ ID NO: 2489 - RNA, 20 nt, Artificial Sequence
  synthesized
ggguuucuuccauggguauc

SEQ ID NO: 2490 - RNA, 20 nt, Artificial Sequence
  synthesized
guuucuuccacgguauccag

SEQ ID NO: 2491 - RNA, 20 nt, Artificial Sequence
  synthesized
guuucuuccauggguaucca

SEQ ID NO: 2492 - RNA, 20 nt, Artificial Sequence
  synthesized
uacccauggaagaaacccuu

SEQ ID NO: 2493 - RNA, 20 nt, Artificial Sequence
  synthesized
ucaaggguuucuuccacggu

SEQ ID NO: 2494 - RNA, 20 nt, Artificial Sequence
  synthesized
ucaaggguuucuuccauggg

SEQ ID NO: 2495 - RNA, 20 nt, Artificial Sequence
  synthesized
uccacgguauccagugcugu

SEQ ID NO: 2496 - RNA, 20 nt, Artificial Sequence
  synthesized
uccauggguauccagugcug

SEQ ID NO: 2497 - RNA, 20 nt, Artificial Sequence
  synthesized
uggauacccauggaagaaac

SEQ ID NO: 2498 - RNA, 20 nt, Artificial Sequence
  synthesized
uggguauccagugcuguucu

SEQ ID NO: 2499 - RNA, 20 nt, Artificial Sequence
  synthesized
uucuuccacgguauccagug

SEQ ID NO: 2500 - RNA, 20 nt, Artificial Sequence
  synthesized
uucuuccauggguauccagu

SEQ ID NO: 2501 - RNA, 20 nt, Artificial Sequence
  synthesized
acacccccacacuacagugg

SEQ ID NO: 2502 - RNA, 20 nt, Artificial Sequence
  synthesized
acacucccacacuacagugg

SEQ ID NO: 2503 - RNA, 20 nt, Artificial Sequence
  synthesized
acccccacacuacaguggua

SEQ ID NO: 2504 - RNA, 20 nt, Artificial Sequence
  synthesized
acucccacacuacaguggua

SEQ ID NO: 2505 - RNA, 20 nt, Artificial Sequence
  synthesized
acuguagugugggaguguug

SEQ ID NO: 2506 - RNA, 20 nt, Artificial Sequence
  synthesized
acuguaguguggggguguug

SEQ ID NO: 2507 - RNA, 20 nt, Artificial Sequence
  synthesized
aucaacacccccacacuaca

SEQ ID NO: 2508 - RNA, 20 nt, Artificial Sequence
  synthesized
aucaacacucccacacuaca

SEQ ID NO: 2509 - RNA, 20 nt, Artificial Sequence
  synthesized
cacuaucaacacccccacac

SEQ ID NO: 2510 - RNA, 20 nt, Artificial Sequence
  synthesized
cacuaucaacacucccacac

SEQ ID NO: 2511 - RNA, 20 nt, Artificial Sequence
  synthesized
cccacuaucaacacccccac

SEQ ID NO: 2512 - RNA, 20 nt, Artificial Sequence
  synthesized
cccacuaucaacacucccac

SEQ ID NO: 2513 - RNA, 20 nt, Artificial Sequence
  synthesized
ccccacacuacagugguaga

SEQ ID NO: 2514 - RNA, 20 nt, Artificial Sequence
  synthesized
ccuccccacuaucaacaccc

SEQ ID NO: 2515 - RNA, 20 nt, Artificial Sequence
  synthesized
ccuccccacuaucaacacuc

SEQ ID NO: 2516 - RNA, 20 nt, Artificial Sequence
  synthesized
cuaucaacacccccacacua

SEQ ID NO: 2517 - RNA, 20 nt, Artificial Sequence
  synthesized
cuaucaacacucccacacua

SEQ ID NO: 2518 - RNA, 20 nt, Artificial Sequence
  synthesized
gaguguugauaguggggagg

SEQ ID NO: 2519 - RNA, 20 nt, Artificial Sequence
  synthesized
gggaguguugauagugggga

SEQ ID NO: 2520 - RNA, 20 nt, Artificial Sequence
  synthesized
ggggguguugauagugggga

SEQ ID NO: 2521 - RNA, 20 nt, Artificial Sequence
  synthesized
ggguguugauaguggggagg

SEQ ID NO: 2522 - RNA, 20 nt, Artificial Sequence
  synthesized
gugggaguguugauaguggg

SEQ ID NO: 2523 - RNA, 20 nt, Artificial Sequence
  synthesized
guggggguguugauaguggg

SEQ ID NO: 2524 - RNA, 20 nt, Artificial Sequence
  synthesized
ucccacacuacagugguaga

SEQ ID NO: 2525 - RNA, 20 nt, Artificial Sequence
  synthesized
uccccacuaucaacaccccc

SEQ ID NO: 2526 - RNA, 20 nt, Artificial Sequence
  synthesized
uccccacuaucaacacuccc

SEQ ID NO: 2527 - RNA, 20 nt, Artificial Sequence
  synthesized
ucuaccacuguaguguggga

SEQ ID NO: 2528 - RNA, 20 nt, Artificial Sequence
  synthesized
ucuaccacuguagugugggg

SEQ ID NO: 2529 - RNA, 20 nt, Artificial Sequence
  synthesized
acggguguaagccaaagggc

SEQ ID NO: 2530 - RNA, 20 nt, Artificial Sequence
  synthesized
auggguguaagccaaagggc

SEQ ID NO: 2531 - RNA, 20 nt, Artificial Sequence
  synthesized
ccuuuggcuuacacccauaa

SEQ ID NO: 2532 - RNA, 20 nt, Artificial Sequence
  synthesized
ccuuuggcuuacacccguaa

SEQ ID NO: 2533 - RNA, 20 nt, Artificial Sequence
  synthesized
cugggauuacggguguaagc

SEQ ID NO: 2534 - RNA, 20 nt, Artificial Sequence
  synthesized
cugggauuauggguguaagc

SEQ ID NO: 2535 - RNA, 20 nt, Artificial Sequence
  synthesized
gcccuuuggcuuacacccau

SEQ ID NO: 2536 - RNA, 20 nt, Artificial Sequence
  synthesized
gcccuuuggcuuacacccgu

SEQ ID NO: 2537 - RNA, 20 nt, Artificial Sequence
  synthesized
uuacggguguaagccaaagg

SEQ ID NO: 2538 - RNA, 20 nt, Artificial Sequence
  synthesized
uuauggguguaagccaaagg

SEQ ID NO: 2539 - RNA, 20 nt, Artificial Sequence
  synthesized
uuuggcuuacacccauaauc

SEQ ID NO: 2540 - RNA, 20 nt, Artificial Sequence
  synthesized
uuuggcuuacacccguaauc

SEQ ID NO: 2541 - RNA, 20 nt, Artificial Sequence
  synthesized
aaaguccagacccaacuuca

SEQ ID NO: 2542 - RNA, 20 nt, Artificial Sequence
  synthesized
aaaguccggacccaacuuca

SEQ ID NO: 2543 - RNA, 20 nt, Artificial Sequence
  synthesized
acacuuugaaguuggguccg

SEQ ID NO: 2544 - RNA, 20 nt, Artificial Sequence
  synthesized
acacuuugaaguugggucug

SEQ ID NO: 2545 - RNA, 20 nt, Artificial Sequence
  synthesized
acuuggcacuucaaagucca

SEQ ID NO: 2546 - RNA, 20 nt, Artificial Sequence
  synthesized
acuuggcacuucaaaguccg

SEQ ID NO: 2547 - RNA, 20 nt, Artificial Sequence
  synthesized
acuuugaaguuggguccgga

SEQ ID NO: 2548 - RNA, 20 nt, Artificial Sequence
  synthesized
acuuugaaguugggucugga

SEQ ID NO: 2549 - RNA, 20 nt, Artificial Sequence
  synthesized
aguccagacccaacuucaaa

SEQ ID NO: 2550 - RNA, 20 nt, Artificial Sequence
  synthesized
aguccggacccaacuucaaa

SEQ ID NO: 2551 - RNA, 20 nt, Artificial Sequence
  synthesized
cacuucaaaguccagaccca

SEQ ID NO: 2552 - RNA, 20 nt, Artificial Sequence
  synthesized
cacuucaaaguccggaccca

SEQ ID NO: 2553 - RNA, 20 nt, Artificial Sequence
  synthesized
cggacuuugaagugccaagu

SEQ ID NO: 2554 - RNA, 20 nt, Artificial Sequence
  synthesized
cuucaaaguccagacccaac

SEQ ID NO: 2555 - RNA, 20 nt, Artificial Sequence
  synthesized
cuucaaaguccggacccaac

SEQ ID NO: 2556 - RNA, 20 nt, Artificial Sequence
  synthesized
ggcacuucaaaguccagacc

SEQ ID NO: 2557 - RNA, 20 nt, Artificial Sequence
  synthesized
ggcacuucaaaguccggacc

SEQ ID NO: 2558 - RNA, 20 nt, Artificial Sequence
  synthesized
gguccggacuuugaagugcc

SEQ ID NO: 2559 - RNA, 20 nt, Artificial Sequence
  synthesized
ggucuggacuuugaagugcc

SEQ ID NO: 2560 - RNA, 20 nt, Artificial Sequence
  synthesized
guuggguccggacuuugaag

SEQ ID NO: 2561 - RNA, 20 nt, Artificial Sequence
  synthesized
guugggucuggacuuugaag

SEQ ID NO: 2562 - RNA, 20 nt, Artificial Sequence
  synthesized
ucaaaguccagacccaacuu

SEQ ID NO: 2563 - RNA, 20 nt, Artificial Sequence
  synthesized
ucaaaguccggacccaacuu

SEQ ID NO: 2564 - RNA, 20 nt, Artificial Sequence
  synthesized
uccggacuuugaagugccaa

SEQ ID NO: 2565 - RNA, 20 nt, Artificial Sequence
  synthesized
ucuggacuuugaagugccaa

SEQ ID NO: 2566 - RNA, 20 nt, Artificial Sequence
  synthesized
ugaaguuggguccggacuuu

SEQ ID NO: 2567 - RNA, 20 nt, Artificial Sequence
  synthesized
ugaaguugggucuggacuuu

SEQ ID NO: 2568 - RNA, 20 nt, Artificial Sequence
  synthesized
uggacuuugaagugccaagu

SEQ ID NO: 2569 - RNA, 20 nt, Artificial Sequence
  synthesized
uggguccggacuuugaagug

SEQ ID NO: 2570 - RNA, 20 nt, Artificial Sequence
  synthesized
ugggucuggacuuugaagug

SEQ ID NO: 2571 - RNA, 20 nt, Artificial Sequence
  synthesized
uuggcacuucaaaguccaga

SEQ ID NO: 2572 - RNA, 20 nt, Artificial Sequence
  synthesized
uuggcacuucaaaguccgga

SEQ ID NO: 2573 - RNA, 20 nt, Artificial Sequence
  synthesized
uuugaaguuggguccggacu

SEQ ID NO: 2574 - RNA, 20 nt, Artificial Sequence
  synthesized
uuugaaguugggucuggacu

SEQ ID NO: 2575 - RNA, 20 nt, Artificial Sequence
  synthesized
aauaggaaugaugugugugu

SEQ ID NO: 2576 - RNA, 20 nt, Artificial Sequence
  synthesized
acacacacacacaucauucc

SEQ ID NO: 2577 - RNA, 20 nt, Artificial Sequence
  synthesized
acacacacacacgcauuccu

SEQ ID NO: 2578 - RNA, 20 nt, Artificial Sequence
  synthesized
acacacacacaucauuccua

SEQ ID NO: 2579 - RNA, 20 nt, Artificial Sequence
  synthesized
acacacacacgcauuccuau

SEQ ID NO: 2580 - RNA, 20 nt, Artificial Sequence
  synthesized
acacacacaucauuccuauu

SEQ ID NO: 2581 - RNA, 20 nt, Artificial Sequence
  synthesized
acacacacgcauuccuauuc

SEQ ID NO: 2582 - RNA, 20 nt, Artificial Sequence
  synthesized
acacacaucauuccuauucc

SEQ ID NO: 2583 - RNA, 20 nt, Artificial Sequence
  synthesized
acacacgcauuccuauuccu

SEQ ID NO: 2584 - RNA, 20 nt, Artificial Sequence
  synthesized
acacaucauuccuauuccuc

SEQ ID NO: 2585 - RNA, 20 nt, Artificial Sequence
  synthesized
acacgcauuccuauuccucu

SEQ ID NO: 2586 - RNA, 20 nt, Artificial Sequence
  synthesized
acaucauuccuauuccucua

SEQ ID NO: 2587 - RNA, 20 nt, Artificial Sequence
  synthesized
acgcauuccuauuccucuaa

SEQ ID NO: 2588 - RNA, 20 nt, Artificial Sequence
  synthesized
agaggaauaggaaugcgugu

SEQ ID NO: 2589 - RNA, 20 nt, Artificial Sequence
  synthesized
aggaauaggaaugcgugugu

SEQ ID NO: 2590 - RNA, 20 nt, Artificial Sequence
  synthesized
auuuagaggaauaggaaugc

SEQ ID NO: 2591 - RNA, 20 nt, Artificial Sequence
  synthesized
gaauaggaaugcgugugugu

SEQ ID NO: 2592 - RNA, 20 nt, Artificial Sequence
  synthesized
gaauuuagaggaauaggaau

SEQ ID NO: 2593 - RNA, 20 nt, Artificial Sequence
  synthesized
gaggaauaggaaugaugugu

SEQ ID NO: 2594 - RNA, 20 nt, Artificial Sequence
  synthesized
gcauuccuauuccucuaaau

SEQ ID NO: 2595 - RNA, 20 nt, Artificial Sequence
  synthesized
ggaauaggaaugaugugugu

SEQ ID NO: 2596 - RNA, 20 nt, Artificial Sequence
  synthesized
gggaauuuagaggaauagga

SEQ ID NO: 2597 - RNA, 20 nt, Artificial Sequence
  synthesized
uagaggaauaggaaugaugu

SEQ ID NO: 2598 - RNA, 20 nt, Artificial Sequence
  synthesized
uuagaggaauaggaaugcgu

SEQ ID NO: 2599 - RNA, 20 nt, Artificial Sequence
  synthesized
uuuagaggaauaggaaugau

SEQ ID NO: 2600 - RNA, 20 nt, Artificial Sequence
  synthesized
aauccaccagacccccuccc

SEQ ID NO: 2601 - RNA, 20 nt, Artificial Sequence
  synthesized
aauccgccagacccccuccc

SEQ ID NO: 2602 - RNA, 20 nt, Artificial Sequence
  synthesized
aggggagggggucuggcgga

SEQ ID NO: 2603 - RNA, 20 nt, Artificial Sequence
  synthesized
aggggagggggucuggugga

SEQ ID NO: 2604 - RNA, 20 nt, Artificial Sequence
  synthesized
cagaaauccaccagaccccc

SEQ ID NO: 2605 - RNA, 20 nt, Artificial Sequence
  synthesized
cagaaauccgccagaccccc

SEQ ID NO: 2606 - RNA, 20 nt, Artificial Sequence
  synthesized
cccagaaauccaccagaccc

SEQ ID NO: 2607 - RNA, 20 nt, Artificial Sequence
  synthesized
cccagaaauccgccagaccc

SEQ ID NO: 2608 - RNA, 20 nt, Artificial Sequence
  synthesized
cuggcggauuucugggacca

SEQ ID NO: 2609 - RNA, 20 nt, Artificial Sequence
  synthesized
cugguggauuucugggacca

SEQ ID NO: 2610 - RNA, 20 nt, Artificial Sequence
  synthesized
gaaauccaccagacccccuc

SEQ ID NO: 2611 - RNA, 20 nt, Artificial Sequence
  synthesized
gaaauccgccagacccccuc

SEQ ID NO: 2612 - RNA, 20 nt, Artificial Sequence
  synthesized
ggaggggagggggucuggcg

SEQ ID NO: 2613 - RNA, 20 nt, Artificial Sequence
  synthesized
ggaggggagggggucuggug

SEQ ID NO: 2614 - RNA, 20 nt, Artificial Sequence
  synthesized
gggagggggucuggcggauu

SEQ ID NO: 2615 - RNA, 20 nt, Artificial Sequence
  synthesized
gggagggggucugguggauu

SEQ ID NO: 2616 - RNA, 20 nt, Artificial Sequence
  synthesized
gucccagaaauccaccagac

SEQ ID NO: 2617 - RNA, 20 nt, Artificial Sequence
  synthesized
gucccagaaauccgccagac

SEQ ID NO: 2618 - RNA, 20 nt, Artificial Sequence
  synthesized
gucuggcggauuucugggac

SEQ ID NO: 2619 - RNA, 20 nt, Artificial Sequence
  synthesized
gucugguggauuucugggac

SEQ ID NO: 2620 - RNA, 20 nt, Artificial Sequence
  synthesized
uccaccagacccccuccccu

SEQ ID NO: 2621 - RNA, 20 nt, Artificial Sequence
  synthesized
uccgccagacccccuccccu

SEQ ID NO: 2622 - RNA, 20 nt, Artificial Sequence
  synthesized
uggucccagaaauccaccag

SEQ ID NO: 2623 - RNA, 20 nt, Artificial Sequence
  synthesized
uggucccagaaauccgccag

SEQ ID NO: 2624 - RNA, 20 nt, Artificial Sequence
  synthesized
aaauguuuccaaugguucag

SEQ ID NO: 2625 - RNA, 20 nt, Artificial Sequence
  synthesized
aaauguuuccagugguucag

SEQ ID NO: 2626 - RNA, 20 nt, Artificial Sequence
  synthesized
aagcuagacugaaccacugg

SEQ ID NO: 2627 - RNA, 20 nt, Artificial Sequence
  synthesized
aagcuagacugaaccauugg

SEQ ID NO: 2628 - RNA, 20 nt, Artificial Sequence
  synthesized
aaugguucagucuagcuuuc

SEQ ID NO: 2629 - RNA, 20 nt, Artificial Sequence
  synthesized
accacuggaaacauuuaacu

SEQ ID NO: 2630 - RNA, 20 nt, Artificial Sequence
  synthesized
accauuggaaacauuuaacu

SEQ ID NO: 2631 - RNA, 20 nt, Artificial Sequence
  synthesized
agugguucagucuagcuuuc

SEQ ID NO: 2632 - RNA, 20 nt, Artificial Sequence
  synthesized
aguuaaauguuuccaauggu

SEQ ID NO: 2633 - RNA, 20 nt, Artificial Sequence
  synthesized
aguuaaauguuuccaguggu

SEQ ID NO: 2634 - RNA, 20 nt, Artificial Sequence
  synthesized
auguuuccaaugguucaguc

SEQ ID NO: 2635 - RNA, 20 nt, Artificial Sequence
  synthesized
auguuuccagugguucaguc

SEQ ID NO: 2636 - RNA, 20 nt, Artificial Sequence
  synthesized
cacuggaaacauuuaacuca

SEQ ID NO: 2637 - RNA, 20 nt, Artificial Sequence
  synthesized
cauuggaaacauuuaacuca

SEQ ID NO: 2638 - RNA, 20 nt, Artificial Sequence
  synthesized
ccaaugguucagucuagcuu

SEQ ID NO: 2639 - RNA, 20 nt, Artificial Sequence
  synthesized
ccagugguucagucuagcuu

SEQ ID NO: 2640 - RNA, 20 nt, Artificial Sequence
  synthesized
cugaaccacuggaaacauuu

SEQ ID NO: 2641 - RNA, 20 nt, Artificial Sequence
  synthesized
cugaaccauuggaaacauuu

SEQ ID NO: 2642 - RNA, 20 nt, Artificial Sequence
  synthesized
cuggaaacauuuaacucaga

SEQ ID NO: 2643 - RNA, 20 nt, Artificial Sequence
  synthesized
gaaccacuggaaacauuuaa

SEQ ID NO: 2644 - RNA, 20 nt, Artificial Sequence
  synthesized
gaaccauuggaaacauuuaa

SEQ ID NO: 2645 - RNA, 20 nt, Artificial Sequence
  synthesized
gacugaaccacuggaaacau

SEQ ID NO: 2646 - RNA, 20 nt, Artificial Sequence
  synthesized
gacugaaccauuggaaacau

SEQ ID NO: 2647 - RNA, 20 nt, Artificial Sequence
  synthesized
gcuagacugaaccacuggaa

SEQ ID NO: 2648 - RNA, 20 nt, Artificial Sequence
  synthesized
gcuagacugaaccauuggaa

SEQ ID NO: 2649 - RNA, 20 nt, Artificial Sequence
  synthesized
guuuccaaugguucagucua

SEQ ID NO: 2650 - RNA, 20 nt, Artificial Sequence
  synthesized
guuuccagugguucagucua

SEQ ID NO: 2651 - RNA, 20 nt, Artificial Sequence
  synthesized
uagacugaaccacuggaaac

SEQ ID NO: 2652 - RNA, 20 nt, Artificial Sequence
  synthesized
uagacugaaccauuggaaac

SEQ ID NO: 2653 - RNA, 20 nt, Artificial Sequence
  synthesized
ugaguuaaauguuuccaaug

SEQ ID NO: 2654 - RNA, 20 nt, Artificial Sequence
  synthesized
ugaguuaaauguuuccagug

SEQ ID NO: 2655 - RNA, 20 nt, Artificial Sequence
  synthesized
uuaaauguuuccaaugguuc

SEQ ID NO: 2656 - RNA, 20 nt, Artificial Sequence
  synthesized
uuaaauguuuccagugguuc

SEQ ID NO: 2657 - RNA, 20 nt, Artificial Sequence
  synthesized
uuggaaacauuuaacucaga

SEQ ID NO: 2658 - RNA, 20 nt, Artificial Sequence
  synthesized
aaaggcagugacucagccaa

SEQ ID NO: 2659 - RNA, 20 nt, Artificial Sequence
  synthesized
aaaggcagugacucagccga

SEQ ID NO: 2660 - RNA, 20 nt, Artificial Sequence
  synthesized
aagugauacacucagggaca

SEQ ID NO: 2661 - RNA, 20 nt, Artificial Sequence
  synthesized
acucagccaagugauacacu

SEQ ID NO: 2662 - RNA, 20 nt, Artificial Sequence
  synthesized
acucagccgagugauacacu

SEQ ID NO: 2663 - RNA, 20 nt, Artificial Sequence
  synthesized
acucggcugagucacugccu

SEQ ID NO: 2664 - RNA, 20 nt, Artificial Sequence
  synthesized
acuuggcugagucacugccu

SEQ ID NO: 2665 - RNA, 20 nt, Artificial Sequence
  synthesized
agccaagugauacacucagg

SEQ ID NO: 2666 - RNA, 20 nt, Artificial Sequence
  synthesized
agccgagugauacacucagg

SEQ ID NO: 2667 - RNA, 20 nt, Artificial Sequence
  synthesized
aggcagugacucagccaagu

SEQ ID NO: 2668 - RNA, 20 nt, Artificial Sequence
  synthesized
aggcagugacucagccgagu

SEQ ID NO: 2669 - RNA, 20 nt, Artificial Sequence
  synthesized
agugacucagccaagugaua

SEQ ID NO: 2670 - RNA, 20 nt, Artificial Sequence
  synthesized
aguguaucacuuggcugagu

SEQ ID NO: 2671 - RNA, 20 nt, Artificial Sequence
  synthesized
ccaagugauacacucaggga

SEQ ID NO: 2672 - RNA, 20 nt, Artificial Sequence
  synthesized
ccgagugauacacucaggga

SEQ ID NO: 2673 - RNA, 20 nt, Artificial Sequence
  synthesized
ccugaguguaucacucggcu

SEQ ID NO: 2674 - RNA, 20 nt, Artificial Sequence
  synthesized
ccugaguguaucacuuggcu

SEQ ID NO: 2675 - RNA, 20 nt, Artificial Sequence
  synthesized
gagugauacacucagggaca

SEQ ID NO: 2676 - RNA, 20 nt, Artificial Sequence
  synthesized
gcagugacucagccaaguga

SEQ ID NO: 2677 - RNA, 20 nt, Artificial Sequence
  synthesized
gcagugacucagccgaguga

SEQ ID NO: 2678 - RNA, 20 nt, Artificial Sequence
  synthesized
uaucacucggcugagucacu

SEQ ID NO: 2679 - RNA, 20 nt, Artificial Sequence
  synthesized
uaucacuuggcugagucacu

SEQ ID NO: 2680 - RNA, 20 nt, Artificial Sequence
  synthesized
ucacucggcugagucacugc

SEQ ID NO: 2681 - RNA, 20 nt, Artificial Sequence
  synthesized
ucacuuggcugagucacugc

SEQ ID NO: 2682 - RNA, 20 nt, Artificial Sequence
  synthesized
ucggcugagucacugccuuu

SEQ ID NO: 2683 - RNA, 20 nt, Artificial Sequence
  synthesized
ugacucagccaagugauaca

SEQ ID NO: 2684 - RNA, 20 nt, Artificial Sequence
  synthesized
ugacucagccgagugauaca

SEQ ID NO: 2685 - RNA, 20 nt, Artificial Sequence
  synthesized
ugaguguaucacucggcuga

SEQ ID NO: 2686 - RNA, 20 nt, Artificial Sequence
  synthesized
ugaguguaucacuuggcuga

SEQ ID NO: 2687 - RNA, 20 nt, Artificial Sequence
  synthesized
uguaucacucggcugaguca

SEQ ID NO: 2688 - RNA, 20 nt, Artificial Sequence
  synthesized
uguaucacuuggcugaguca

SEQ ID NO: 2689 - RNA, 20 nt, Artificial Sequence
  synthesized
ugucccugaguguaucacuc

SEQ ID NO: 2690 - RNA, 20 nt, Artificial Sequence
  synthesized
ugucccugaguguaucacuu

SEQ ID NO: 2691 - RNA, 20 nt, Artificial Sequence
  synthesized
uuggcugagucacugccuuu

SEQ ID NO: 2692 - RNA, 20 nt, Artificial Sequence
  synthesized
aggucuagcccagcccuggg

SEQ ID NO: 2693 - RNA, 20 nt, Artificial Sequence
  synthesized
aggucuagcccggcccuggg

SEQ ID NO: 2694 - RNA, 20 nt, Artificial Sequence
  synthesized
cagcccuggguaggaguggg

SEQ ID NO: 2695 - RNA, 20 nt, Artificial Sequence
  synthesized
ccaggucuagcccagcccug

SEQ ID NO: 2696 - RNA, 20 nt, Artificial Sequence
  synthesized
ccaggucuagcccggcccug

SEQ ID NO: 2697 - RNA, 20 nt, Artificial Sequence
  synthesized
cccacuccuacccagggccg

SEQ ID NO: 2698 - RNA, 20 nt, Artificial Sequence
  synthesized
cccacuccuacccagggcug

SEQ ID NO: 2699 - RNA, 20 nt, Artificial Sequence
  synthesized
ccuacccagggccgggcuag

SEQ ID NO: 2700 - RNA, 20 nt, Artificial Sequence
  synthesized
ccuacccagggcugggcuag

SEQ ID NO: 2701 - RNA, 20 nt, Artificial Sequence
  synthesized
cggcccuggguaggaguggg

SEQ ID NO: 2702 - RNA, 20 nt, Artificial Sequence
  synthesized
cgggcuagaccuggggacag

SEQ ID NO: 2703 - RNA, 20 nt, Artificial Sequence
  synthesized
cuguccccaggucuagccca

SEQ ID NO: 2704 - RNA, 20 nt, Artificial Sequence
  synthesized
cuguccccaggucuagcccg

SEQ ID NO: 2705 - RNA, 20 nt, Artificial Sequence
  synthesized
gccgggcuagaccuggggac

SEQ ID NO: 2706 - RNA, 20 nt, Artificial Sequence
  synthesized
gcugggcuagaccuggggac

SEQ ID NO: 2707 - RNA, 20 nt, Artificial Sequence
  synthesized
gggccgggcuagaccugggg

SEQ ID NO: 2708 - RNA, 20 nt, Artificial Sequence
  synthesized
gggcugggcuagaccugggg

SEQ ID NO: 2709 - RNA, 20 nt, Artificial Sequence
  synthesized
guccccaggucuagcccagc

SEQ ID NO: 2710 - RNA, 20 nt, Artificial Sequence
  synthesized
guccccaggucuagcccggc

SEQ ID NO: 2711 - RNA, 20 nt, Artificial Sequence
  synthesized
uacccagggccgggcuagac

SEQ ID NO: 2712 - RNA, 20 nt, Artificial Sequence
  synthesized
uacccagggcugggcuagac

SEQ ID NO: 2713 - RNA, 20 nt, Artificial Sequence
  synthesized
ugggcuagaccuggggacag

SEQ ID NO: 2714 - RNA, 20 nt, Artificial Sequence
  synthesized
aaaauaccuuggugcccuag

SEQ ID NO: 2715 - RNA, 20 nt, Artificial Sequence
  synthesized
aaaguaccuuggugcccuag

SEQ ID NO: 2716 - RNA, 20 nt, Artificial Sequence
  synthesized
aauaccuuggugcccuagua

SEQ ID NO: 2717 - RNA, 20 nt, Artificial Sequence
  synthesized
agggcaccaagguacuuuaa

SEQ ID NO: 2718 - RNA, 20 nt, Artificial Sequence
  synthesized
agggcaccaagguauuuuaa

SEQ ID NO: 2719 - RNA, 20 nt, Artificial Sequence
  synthesized
aguaccuuggugcccuagua

SEQ ID NO: 2720 - RNA, 20 nt, Artificial Sequence
  synthesized
caccaagguacuuuaaaaaa

SEQ ID NO: 2721 - RNA, 20 nt, Artificial Sequence
  synthesized
ccaagguacuuuaaaaaaag

SEQ ID NO: 2722 - RNA, 20 nt, Artificial Sequence
  synthesized
cuagggcaccaagguacuuu

SEQ ID NO: 2723 - RNA, 20 nt, Artificial Sequence
  synthesized
cuagggcaccaagguauuuu

SEQ ID NO: 2724 - RNA, 20 nt, Artificial Sequence
  synthesized
cuuuuuuuaaaguaccuugg

SEQ ID NO: 2725 - RNA, 20 nt, Artificial Sequence
  synthesized
ggcaccaagguacuuuaaaa

SEQ ID NO: 2726 - RNA, 20 nt, Artificial Sequence
  synthesized
ggcaccaagguauuuuaaaa

SEQ ID NO: 2727 - RNA, 20 nt, Artificial Sequence
  synthesized
ggcccuaacuuuuuuuaaaa

SEQ ID NO: 2728 - RNA, 20 nt, Artificial Sequence
  synthesized
ggcccuaacuuuuuuuaaag

SEQ ID NO: 2729 - RNA, 20 nt, Artificial Sequence
  synthesized
uacuagggcaccaagguacu

SEQ ID NO: 2730 - RNA, 20 nt, Artificial Sequence
  synthesized
uacuagggcaccaagguauu

SEQ ID NO: 2731 - RNA, 20 nt, Artificial Sequence
  synthesized
uuaaaauaccuuggugcccu

SEQ ID NO: 2732 - RNA, 20 nt, Artificial Sequence
  synthesized
uuaaaguaccuuggugcccu

SEQ ID NO: 2733 - RNA, 20 nt, Artificial Sequence
  synthesized
uuuuaaaauaccuuggugcc

SEQ ID NO: 2734 - RNA, 20 nt, Artificial Sequence
  synthesized
uuuuaaaguaccuuggugcc

SEQ ID NO: 2735 - RNA, 20 nt, Artificial Sequence
  synthesized
uuuuuuaaaguaccuuggug

SEQ ID NO: 2736 - RNA, 20 nt, Artificial Sequence
  synthesized
agcccagggccccuccugag

SEQ ID NO: 2737 - RNA, 20 nt, Artificial Sequence
  synthesized
agcccagggccgcuccugag

SEQ ID NO: 2738 - RNA, 20 nt, Artificial Sequence
  synthesized
agcggcccugggcuggggaa

SEQ ID NO: 2739 - RNA, 20 nt, Artificial Sequence
  synthesized
aggccucaggagcggcccug

SEQ ID NO: 2740 - RNA, 20 nt, Artificial Sequence
  synthesized
aggccucaggaggggcccug

SEQ ID NO: 2741 - RNA, 20 nt, Artificial Sequence
  synthesized
aggggcccugggcuggggaa

SEQ ID NO: 2742 - RNA, 20 nt, Artificial Sequence
  synthesized
cagggccccuccugaggccu

SEQ ID NO: 2743 - RNA, 20 nt, Artificial Sequence
  synthesized
cagggccgcuccugaggccu

SEQ ID NO: 2744 - RNA, 20 nt, Artificial Sequence
  synthesized
cccuccugaggccugagcca

SEQ ID NO: 2745 - RNA, 20 nt, Artificial Sequence
  synthesized
cgcuccugaggccugagcca

SEQ ID NO: 2746 - RNA, 20 nt, Artificial Sequence
  synthesized
gccccuccugaggccugagc

SEQ ID NO: 2747 - RNA, 20 nt, Artificial Sequence
  synthesized
gccgcuccugaggccugagc

SEQ ID NO: 2748 - RNA, 20 nt, Artificial Sequence
  synthesized
gccucaggagcggcccuggg

SEQ ID NO: 2749 - RNA, 20 nt, Artificial Sequence
  synthesized
gccucaggaggggcccuggg

SEQ ID NO: 2750 - RNA, 20 nt, Artificial Sequence
  synthesized
gcucaggccucaggagcggc

SEQ ID NO: 2751 - RNA, 20 nt, Artificial Sequence
  synthesized
gcucaggccucaggaggggc

SEQ ID NO: 2752 - RNA, 20 nt, Artificial Sequence
  synthesized
ggagcggcccugggcugggg

SEQ ID NO: 2753 - RNA, 20 nt, Artificial Sequence
  synthesized
ggaggggcccugggcugggg

SEQ ID NO: 2754 - RNA, 20 nt, Artificial Sequence
  synthesized
gggccccuccugaggccuga

SEQ ID NO: 2755 - RNA, 20 nt, Artificial Sequence
  synthesized
gggccgcuccugaggccuga

SEQ ID NO: 2756 - RNA, 20 nt, Artificial Sequence
  synthesized
uggcucaggccucaggagcg

SEQ ID NO: 2757 - RNA, 20 nt, Artificial Sequence
  synthesized
uggcucaggccucaggaggg

SEQ ID NO: 2758 - RNA, 20 nt, Artificial Sequence
  synthesized
uuccccagcccagggccccu

SEQ ID NO: 2759 - RNA, 20 nt, Artificial Sequence
  synthesized
uuccccagcccagggccgcu

SEQ ID NO: 2760 - RNA, 20 nt, Artificial Sequence
  synthesized
uuuuccccagcccagggccc

SEQ ID NO: 2761 - RNA, 20 nt, Artificial Sequence
  synthesized
uuuuccccagcccagggccg

SEQ ID NO: 2762 - RNA, 20 nt, Artificial Sequence
  synthesized
aaaucagauuaggcucaguu

SEQ ID NO: 2763 - RNA, 20 nt, Artificial Sequence
  synthesized
aacugagccuaaucugauuc

SEQ ID NO: 2764 - RNA, 20 nt, Artificial Sequence
  synthesized
aacugagccuaaucugauuu

SEQ ID NO: 2765 - RNA, 20 nt, Artificial Sequence
  synthesized
aaucugauuccugccuguac

SEQ ID NO: 2766 - RNA, 20 nt, Artificial Sequence
  synthesized
aaucugauuucugccuguac

SEQ ID NO: 2767 - RNA, 20 nt, Artificial Sequence
  synthesized
acaggcagaaaucagauuag

SEQ ID NO: 2768 - RNA, 20 nt, Artificial Sequence
  synthesized
acaggcaggaaucagauuag

SEQ ID NO: 2769 - RNA, 20 nt, Artificial Sequence
  synthesized
acguacaggcagaaaucaga

SEQ ID NO: 2770 - RNA, 20 nt, Artificial Sequence
  synthesized
acguacaggcaggaaucaga

SEQ ID NO: 2771 - RNA, 20 nt, Artificial Sequence
  synthesized
agaaaucagauuaggcucag

SEQ ID NO: 2772 - RNA, 20 nt, Artificial Sequence
  synthesized
aggaaucagauuaggcucag

SEQ ID NO: 2773 - RNA, 20 nt, Artificial Sequence
  synthesized
aggcagaaaucagauuaggc

SEQ ID NO: 2774 - RNA, 20 nt, Artificial Sequence
  synthesized
aggcaggaaucagauuaggc

SEQ ID NO: 2775 - RNA, 20 nt, Artificial Sequence
  synthesized
auacguacaggcagaaauca

SEQ ID NO: 2776 - RNA, 20 nt, Artificial Sequence
  synthesized
auacguacaggcaggaauca

SEQ ID NO: 2777 - RNA, 20 nt, Artificial Sequence
  synthesized
aucugauuccugccuguacg

SEQ ID NO: 2778 - RNA, 20 nt, Artificial Sequence
  synthesized
auuccugccuguacguauuc

SEQ ID NO: 2779 - RNA, 20 nt, Artificial Sequence
  synthesized
auuucugccuguacguauuc

SEQ ID NO: 2780 - RNA, 20 nt, Artificial Sequence
  synthesized
ccugccuguacguauucaua

SEQ ID NO: 2781 - RNA, 20 nt, Artificial Sequence
  synthesized
cuaaucugauuccugccugu

SEQ ID NO: 2782 - RNA, 20 nt, Artificial Sequence
  synthesized
cuaaucugauuucugccugu

SEQ ID NO: 2783 - RNA, 20 nt, Artificial Sequence
  synthesized
cugagccuaaucugauuccu

SEQ ID NO: 2784 - RNA, 20 nt, Artificial Sequence
  synthesized
cugagccuaaucugauuucu

SEQ ID NO: 2785 - RNA, 20 nt, Artificial Sequence
  synthesized
cugauuccugccuguacgua

SEQ ID NO: 2786 - RNA, 20 nt, Artificial Sequence
  synthesized
gaauacguacaggcagaaau

SEQ ID NO: 2787 - RNA, 20 nt, Artificial Sequence
  synthesized
gaauacguacaggcaggaau

SEQ ID NO: 2788 - RNA, 20 nt, Artificial Sequence
  synthesized
gaaucagauuaggcucaguu

SEQ ID NO: 2789 - RNA, 20 nt, Artificial Sequence
  synthesized
gagccuaaucugauuccugc

SEQ ID NO: 2790 - RNA, 20 nt, Artificial Sequence
  synthesized
gagccuaaucugauuucugc

SEQ ID NO: 2791 - RNA, 20 nt, Artificial Sequence
  synthesized
gcagaaaucagauuaggcuc

SEQ ID NO: 2792 - RNA, 20 nt, Artificial Sequence
  synthesized
gcaggaaucagauuaggcuc

SEQ ID NO: 2793 - RNA, 20 nt, Artificial Sequence
  synthesized
uaugaauacguacaggcagg

SEQ ID NO: 2794 - RNA, 20 nt, Artificial Sequence
  synthesized
uccugccuguacguauucau

SEQ ID NO: 2795 - RNA, 20 nt, Artificial Sequence
  synthesized
ugaauacguacaggcaggaa

SEQ ID NO: 2796 - RNA, 20 nt, Artificial Sequence
  synthesized
ugauuccugccuguacguau

SEQ ID NO: 2797 - RNA, 20 nt, Artificial Sequence
  synthesized
ugauuucugccuguacguau

SEQ ID NO: 2798 - RNA, 20 nt, Artificial Sequence
  synthesized
uuccugccuguacguauuca

SEQ ID NO: 2799 - RNA, 20 nt, Artificial Sequence
  synthesized
uucugccuguacguauucau

SEQ ID NO: 2800 - RNA, 20 nt, Artificial Sequence
  synthesized
aagaucagugcagaccacgg

SEQ ID NO: 2801 - RNA, 20 nt, Artificial Sequence
  synthesized
aagccugguucacuggucaa

SEQ ID NO: 2802 - RNA, 20 nt, Artificial Sequence
  synthesized
aagccugguucacuggucag

SEQ ID NO: 2803 - RNA, 20 nt, Artificial Sequence
  synthesized
aggaucagugcagaccacgg

SEQ ID NO: 2804 - RNA, 20 nt, Artificial Sequence
  synthesized
cacugauccugaccagugaa

SEQ ID NO: 2805 - RNA, 20 nt, Artificial Sequence
  synthesized
cacugaucuugaccagugaa

SEQ ID NO: 2806 - RNA, 20 nt, Artificial Sequence
  synthesized
cacuggucaagaucagugca

SEQ ID NO: 2807 - RNA, 20 nt, Artificial Sequence
  synthesized
cacuggucaggaucagugca

SEQ ID NO: 2808 - RNA, 20 nt, Artificial Sequence
  synthesized
ccguggucugcacugauccu

SEQ ID NO: 2809 - RNA, 20 nt, Artificial Sequence
  synthesized
ccguggucugcacugaucuu

SEQ ID NO: 2810 - RNA, 20 nt, Artificial Sequence
  synthesized
cugaccagugaaccaggcuu

SEQ ID NO: 2811 - RNA, 20 nt, Artificial Sequence
  synthesized
cuggucaagaucagugcaga

SEQ ID NO: 2812 - RNA, 20 nt, Artificial Sequence
  synthesized
cuggucaggaucagugcaga

SEQ ID NO: 2813 - RNA, 20 nt, Artificial Sequence
  synthesized
gauccugaccagugaaccag

SEQ ID NO: 2814 - RNA, 20 nt, Artificial Sequence
  synthesized
gaucuugaccagugaaccag

SEQ ID NO: 2815 - RNA, 20 nt, Artificial Sequence
  synthesized
gccugguucacuggucaaga

SEQ ID NO: 2816 - RNA, 20 nt, Artificial Sequence
  synthesized
gccugguucacuggucagga

SEQ ID NO: 2817 - RNA, 20 nt, Artificial Sequence
  synthesized
ggucaagaucagugcagacc

SEQ ID NO: 2818 - RNA, 20 nt, Artificial Sequence
  synthesized
ggucaggaucagugcagacc

SEQ ID NO: 2819 - RNA, 20 nt, Artificial Sequence
  synthesized
gguucacuggucaagaucag

SEQ ID NO: 2820 - RNA, 20 nt, Artificial Sequence
  synthesized
gguucacuggucaggaucag

SEQ ID NO: 2821 - RNA, 20 nt, Artificial Sequence
  synthesized
guggucugcacugauccuga

SEQ ID NO: 2822 - RNA, 20 nt, Artificial Sequence
  synthesized
guggucugcacugaucuuga

SEQ ID NO: 2823 - RNA, 20 nt, Artificial Sequence
  synthesized
uccugaccagugaaccaggc

SEQ ID NO: 2824 - RNA, 20 nt, Artificial Sequence
  synthesized
ucuugaccagugaaccaggc

SEQ ID NO: 2825 - RNA, 20 nt, Artificial Sequence
  synthesized
ugcacugauccugaccagug

SEQ ID NO: 2826 - RNA, 20 nt, Artificial Sequence
  synthesized
ugcacugaucuugaccagug

SEQ ID NO: 2827 - RNA, 20 nt, Artificial Sequence
  synthesized
uucacuggucaagaucagug

SEQ ID NO: 2828 - RNA, 20 nt, Artificial Sequence
  synthesized
uucacuggucaggaucagug

SEQ ID NO: 2829 - RNA, 20 nt, Artificial Sequence
  synthesized
uugaccagugaaccaggcuu

SEQ ID NO: 2830 - RNA, 20 nt, Artificial Sequence
  synthesized
acgacuggauuaguauacca

SEQ ID NO: 2831 - RNA, 20 nt, Artificial Sequence
  synthesized
acgacuggauuaguauccca

SEQ ID NO: 2832 - RNA, 20 nt, Artificial Sequence
  synthesized
auuaguauaccacuggugua

SEQ ID NO: 2833 - RNA, 20 nt, Artificial Sequence
  synthesized
auuaguaucccacuggugua

SEQ ID NO: 2834 - RNA, 20 nt, Artificial Sequence
  synthesized
ccagugggauacuaauccag

SEQ ID NO: 2835 - RNA, 20 nt, Artificial Sequence
  synthesized
ccagugguauacuaauccag

SEQ ID NO: 2836 - RNA, 20 nt, Artificial Sequence
  synthesized
ccuguguauacaccaguggg

SEQ ID NO: 2837 - RNA, 20 nt, Artificial Sequence
  synthesized
ccuguguauacaccaguggu

SEQ ID NO: 2838 - RNA, 20 nt, Artificial Sequence
  synthesized
cuacgacuggauuaguauac

SEQ ID NO: 2839 - RNA, 20 nt, Artificial Sequence
  synthesized
cuacgacuggauuaguaucc

SEQ ID NO: 2840 - RNA, 20 nt, Artificial Sequence
  synthesized
cuggauuaguauaccacugg

SEQ ID NO: 2841 - RNA, 20 nt, Artificial Sequence
  synthesized
cuggauuaguaucccacugg

SEQ ID NO: 2842 - RNA, 20 nt, Artificial Sequence
  synthesized
ggauacuaauccagucguag

SEQ ID NO: 2843 - RNA, 20 nt, Artificial Sequence
  synthesized
ggauuaguauaccacuggug

SEQ ID NO: 2844 - RNA, 20 nt, Artificial Sequence
  synthesized
ggauuaguaucccacuggug

SEQ ID NO: 2845 - RNA, 20 nt, Artificial Sequence
  synthesized
guauaccacugguguauaca

SEQ ID NO: 2846 - RNA, 20 nt, Artificial Sequence
  synthesized
guauacuaauccagucguag

SEQ ID NO: 2847 - RNA, 20 nt, Artificial Sequence
  synthesized
guaucccacugguguauaca

SEQ ID NO: 2848 - RNA, 20 nt, Artificial Sequence
  synthesized
uacaccagugggauacuaau

SEQ ID NO: 2849 - RNA, 20 nt, Artificial Sequence
  synthesized
uacaccagugguauacuaau

SEQ ID NO: 2850 - RNA, 20 nt, Artificial Sequence
  synthesized
uaguauaccacugguguaua

SEQ ID NO: 2851 - RNA, 20 nt, Artificial Sequence
  synthesized
uaguaucccacugguguaua

SEQ ID NO: 2852 - RNA, 20 nt, Artificial Sequence
  synthesized
uauacaccagugggauacua

SEQ ID NO: 2853 - RNA, 20 nt, Artificial Sequence
  synthesized
uauacaccagugguauacua

SEQ ID NO: 2854 - RNA, 20 nt, Artificial Sequence
  synthesized
uguauacaccagugggauac

SEQ ID NO: 2855 - RNA, 20 nt, Artificial Sequence
  synthesized
uguauacaccagugguauac

SEQ ID NO: 2856 - RNA, 20 nt, Artificial Sequence
  synthesized
aacaggcagacauccuguau

SEQ ID NO: 2857 - RNA, 20 nt, Artificial Sequence
  synthesized
aacaggcagauauccuguau

SEQ ID NO: 2858 - RNA, 20 nt, Artificial Sequence
  synthesized
aauuauacaggauaucugcc

SEQ ID NO: 2859 - RNA, 20 nt, Artificial Sequence
  synthesized
aauuauacaggaugucugcc

SEQ ID NO: 2860 - RNA, 20 nt, Artificial Sequence
  synthesized
acaggauaucugccuguuuc

SEQ ID NO: 2861 - RNA, 20 nt, Artificial Sequence
  synthesized
acaggaugucugccuguuuc

SEQ ID NO: 2862 - RNA, 20 nt, Artificial Sequence
  synthesized
acuugaaauuauacaggaug

SEQ ID NO: 2863 - RNA, 20 nt, Artificial Sequence
  synthesized
aggaaacaggcagacauccu

SEQ ID NO: 2864 - RNA, 20 nt, Artificial Sequence
  synthesized
aggaaacaggcagauauccu

SEQ ID NO: 2865 - RNA, 20 nt, Artificial Sequence
  synthesized
aggauaucugccuguuuccu

SEQ ID NO: 2866 - RNA, 20 nt, Artificial Sequence
  synthesized
aggaugucugccuguuuccu

SEQ ID NO: 2867 - RNA, 20 nt, Artificial Sequence
  synthesized
aggcaggaaacaggcagaca

SEQ ID NO: 2868 - RNA, 20 nt, Artificial Sequence
  synthesized
aggcaggaaacaggcagaua

SEQ ID NO: 2869 - RNA, 20 nt, Artificial Sequence
  synthesized
auacaggauaucugccuguu

SEQ ID NO: 2870 - RNA, 20 nt, Artificial Sequence
  synthesized
auacaggaugucugccuguu

SEQ ID NO: 2871 - RNA, 20 nt, Artificial Sequence
  synthesized
cagacauccuguauaauuuc

SEQ ID NO: 2872 - RNA, 20 nt, Artificial Sequence
  synthesized
cagauauccuguauaauuuc

SEQ ID NO: 2873 - RNA, 20 nt, Artificial Sequence
  synthesized
caggcagacauccuguauaa

SEQ ID NO: 2874 - RNA, 20 nt, Artificial Sequence
  synthesized
caggcagauauccuguauaa

SEQ ID NO: 2875 - RNA, 20 nt, Artificial Sequence
  synthesized
gaaacaggcagacauccugu

SEQ ID NO: 2876 - RNA, 20 nt, Artificial Sequence
  synthesized
gaaacaggcagauauccugu

SEQ ID NO: 2877 - RNA, 20 nt, Artificial Sequence
  synthesized
gaaauuauacaggauaucug

SEQ ID NO: 2878 - RNA, 20 nt, Artificial Sequence
  synthesized
gaaauuauacaggaugucug

SEQ ID NO: 2879 - RNA, 20 nt, Artificial Sequence
  synthesized
gacauccuguauaauuucaa

SEQ ID NO: 2880 - RNA, 20 nt, Artificial Sequence
  synthesized
gauaucugccuguuuccugc

SEQ ID NO: 2881 - RNA, 20 nt, Artificial Sequence
  synthesized
gaugucugccuguuuccugc

SEQ ID NO: 2882 - RNA, 20 nt, Artificial Sequence
  synthesized
gcaggaaacaggcagacauc

SEQ ID NO: 2883 - RNA, 20 nt, Artificial Sequence
  synthesized
gcaggaaacaggcagauauc

SEQ ID NO: 2884 - RNA, 20 nt, Artificial Sequence
  synthesized
uaucugccuguuuccugccu

SEQ ID NO: 2885 - RNA, 20 nt, Artificial Sequence
  synthesized
ugucugccuguuuccugccu

SEQ ID NO: 2886 - RNA, 20 nt, Artificial Sequence
  synthesized
uuauacaggauaucugccug

SEQ ID NO: 2887 - RNA, 20 nt, Artificial Sequence
  synthesized
uuauacaggaugucugccug

SEQ ID NO: 2888 - RNA, 20 nt, Artificial Sequence
  synthesized
uugaaauuauacaggauguc

SEQ ID NO: 2889 - RNA, 20 nt, Artificial Sequence
  synthesized
acagugagccaagguugccc

SEQ ID NO: 2890 - RNA, 20 nt, Artificial Sequence
  synthesized
agccaagguugcccccacug

SEQ ID NO: 2891 - RNA, 20 nt, Artificial Sequence
  synthesized
agugagccaagguugccccc

SEQ ID NO: 2892 - RNA, 20 nt, Artificial Sequence
  synthesized
agugcagugggggcaaccuu

SEQ ID NO: 2893 - RNA, 20 nt, Artificial Sequence
  synthesized
cagugggggcaaccuuggcu

SEQ ID NO: 2894 - RNA, 20 nt, Artificial Sequence
  synthesized
ccaagguugcccccacugca

SEQ ID NO: 2895 - RNA, 20 nt, Artificial Sequence
  synthesized
ggagugcagugggggcaacc

SEQ ID NO: 2896 - RNA, 20 nt, Artificial Sequence
  synthesized
gggcaaccuuggcucacugu

SEQ ID NO: 2897 - RNA, 20 nt, Artificial Sequence
  synthesized
gggcaaucuuggcucacugu

SEQ ID NO: 2898 - RNA, 20 nt, Artificial Sequence
  synthesized
gggggcaaccuuggcucacu

SEQ ID NO: 2899 - RNA, 20 nt, Artificial Sequence
  synthesized
gguuacagugagccaagauu

SEQ ID NO: 2900 - RNA, 20 nt, Artificial Sequence
  synthesized
gguuacagugagccaagguu

SEQ ID NO: 2901 - RNA, 20 nt, Artificial Sequence
  synthesized
gugggggcaaccuuggcuca

SEQ ID NO: 2902 - RNA, 20 nt, Artificial Sequence
  synthesized
ugagccaagguugcccccac

SEQ ID NO: 2903 - RNA, 20 nt, Artificial Sequence
  synthesized
ugcagugggggcaaccuugg

SEQ ID NO: 2904 - RNA, 20 nt, Artificial Sequence
  synthesized
uuacagugagccaagguugc

SEQ ID NO: 2905 - RNA, 20 nt, Artificial Sequence
  synthesized
aagaacacaagaggagcuuc

SEQ ID NO: 2906 - RNA, 20 nt, Artificial Sequence
  synthesized
acaagaacacaagaggagcu

SEQ ID NO: 2907 - RNA, 20 nt, Artificial Sequence
  synthesized
acgagaacacaagaggagcu

SEQ ID NO: 2908 - RNA, 20 nt, Artificial Sequence
  synthesized
agcgccuucuacaagaacac

SEQ ID NO: 2909 - RNA, 20 nt, Artificial Sequence
  synthesized
agcgccuucuacgagaacac

SEQ ID NO: 2910 - RNA, 20 nt, Artificial Sequence
  synthesized
auugagcgccuucuacaaga

SEQ ID NO: 2911 - RNA, 20 nt, Artificial Sequence
  synthesized
auugagcgccuucuacgaga

SEQ ID NO: 2912 - RNA, 20 nt, Artificial Sequence
  synthesized
cgccuucuacaagaacacaa

SEQ ID NO: 2913 - RNA, 20 nt, Artificial Sequence
  synthesized
cgccuucuacgagaacacaa

SEQ ID NO: 2914 - RNA, 20 nt, Artificial Sequence
  synthesized
cuacaagaacacaagaggag

SEQ ID NO: 2915 - RNA, 20 nt, Artificial Sequence
  synthesized
cuacgagaacacaagaggag

SEQ ID NO: 2916 - RNA, 20 nt, Artificial Sequence
  synthesized
cuccucuuguguucucguag

SEQ ID NO: 2917 - RNA, 20 nt, Artificial Sequence
  synthesized
cuccucuuguguucuuguag

SEQ ID NO: 2918 - RNA, 20 nt, Artificial Sequence
  synthesized
gaagcuccucuuguguucuc

SEQ ID NO: 2919 - RNA, 20 nt, Artificial Sequence
  synthesized
gaagcuccucuuguguucuu

SEQ ID NO: 2920 - RNA, 20 nt, Artificial Sequence
  synthesized
gagaacacaagaggagcuuc

SEQ ID NO: 2921 - RNA, 20 nt, Artificial Sequence
  synthesized
guguucucguagaaggcgcu

SEQ ID NO: 2922 - RNA, 20 nt, Artificial Sequence
  synthesized
guguucuuguagaaggcgcu

SEQ ID NO: 2923 - RNA, 20 nt, Artificial Sequence
  synthesized
guucucguagaaggcgcuca

SEQ ID NO: 2924 - RNA, 20 nt, Artificial Sequence
  synthesized
guucuuguagaaggcgcuca

SEQ ID NO: 2925 - RNA, 20 nt, Artificial Sequence
  synthesized
ucguagaaggcgcucaauaa

SEQ ID NO: 2926 - RNA, 20 nt, Artificial Sequence
  synthesized
ucucguagaaggcgcucaau

SEQ ID NO: 2927 - RNA, 20 nt, Artificial Sequence
  synthesized
ucuuguagaaggcgcucaau

SEQ ID NO: 2928 - RNA, 20 nt, Artificial Sequence
  synthesized
ucuuguguucucguagaagg

SEQ ID NO: 2929 - RNA, 20 nt, Artificial Sequence
  synthesized
ucuuguguucuuguagaagg

SEQ ID NO: 2930 - RNA, 20 nt, Artificial Sequence
  synthesized
ugagcgccuucuacaagaac

SEQ ID NO: 2931 - RNA, 20 nt, Artificial Sequence
  synthesized
ugagcgccuucuacgagaac

SEQ ID NO: 2932 - RNA, 20 nt, Artificial Sequence
  synthesized
uucuacaagaacacaagagg

SEQ ID NO: 2933 - RNA, 20 nt, Artificial Sequence
  synthesized
uucuacgagaacacaagagg

SEQ ID NO: 2934 - RNA, 20 nt, Artificial Sequence
  synthesized
uuguagaaggcgcucaauaa

SEQ ID NO: 2935 - RNA, 20 nt, Artificial Sequence
  synthesized
aauucuccagggugccccag

SEQ ID NO: 2936 - RNA, 20 nt, Artificial Sequence
  synthesized
aauucuccggggugccccag

SEQ ID NO: 2937 - RNA, 20 nt, Artificial Sequence
  synthesized
aggccacuggggcaccccgg

SEQ ID NO: 2938 - RNA, 20 nt, Artificial Sequence
  synthesized
aggccacuggggcacccugg

SEQ ID NO: 2939 - RNA, 20 nt, Artificial Sequence
  synthesized
agggugccccaguggccugc

SEQ ID NO: 2940 - RNA, 20 nt, Artificial Sequence
  synthesized
augcuugaaauucuccaggg

SEQ ID NO: 2941 - RNA, 20 nt, Artificial Sequence
  synthesized
augcuugaaauucuccgggg

SEQ ID NO: 2942 - RNA, 20 nt, Artificial Sequence
  synthesized
caccccggagaauuucaagc

SEQ ID NO: 2943 - RNA, 20 nt, Artificial Sequence
  synthesized
cacccuggagaauuucaagc

SEQ ID NO: 2944 - RNA, 20 nt, Artificial Sequence
  synthesized
cacuggggcaccccggagaa

SEQ ID NO: 2945 - RNA, 20 nt, Artificial Sequence
  synthesized
cacuggggcacccuggagaa

SEQ ID NO: 2946 - RNA, 20 nt, Artificial Sequence
  synthesized
ccagggugccccaguggccu

SEQ ID NO: 2947 - RNA, 20 nt, Artificial Sequence
  synthesized
ccccggagaauuucaagcau

SEQ ID NO: 2948 - RNA, 20 nt, Artificial Sequence
  synthesized
cccuggagaauuucaagcau

SEQ ID NO: 2949 - RNA, 20 nt, Artificial Sequence
  synthesized
ccggagaauuucaagcauaa

SEQ ID NO: 2950 - RNA, 20 nt, Artificial Sequence
  synthesized
ccggggugccccaguggccu

SEQ ID NO: 2951 - RNA, 20 nt, Artificial Sequence
  synthesized
cuccagggugccccaguggc

SEQ ID NO: 2952 - RNA, 20 nt, Artificial Sequence
  synthesized
cuccggggugccccaguggc

SEQ ID NO: 2953 - RNA, 20 nt, Artificial Sequence
  synthesized
cuggagaauuucaagcauaa

SEQ ID NO: 2954 - RNA, 20 nt, Artificial Sequence
  synthesized
cuggggcaccccggagaauu

SEQ ID NO: 2955 - RNA, 20 nt, Artificial Sequence
  synthesized
cuggggcacccuggagaauu

SEQ ID NO: 2956 - RNA, 20 nt, Artificial Sequence
  synthesized
gaaauucuccagggugcccc

SEQ ID NO: 2957 - RNA, 20 nt, Artificial Sequence
  synthesized
gaaauucuccggggugcccc

SEQ ID NO: 2958 - RNA, 20 nt, Artificial Sequence
  synthesized
gcaggccacuggggcacccc

SEQ ID NO: 2959 - RNA, 20 nt, Artificial Sequence
  synthesized
gcaggccacuggggcacccu

SEQ ID NO: 2960 - RNA, 20 nt, Artificial Sequence
  synthesized
gccacuggggcaccccggag

SEQ ID NO: 2961 - RNA, 20 nt, Artificial Sequence
  synthesized
gccacuggggcacccuggag

SEQ ID NO: 2962 - RNA, 20 nt, Artificial Sequence
  synthesized
gcuugaaauucuccagggug

SEQ ID NO: 2963 - RNA, 20 nt, Artificial Sequence
  synthesized
gcuugaaauucuccggggug

SEQ ID NO: 2964 - RNA, 20 nt, Artificial Sequence
  synthesized
ggcaccccggagaauuucaa

SEQ ID NO: 2965 - RNA, 20 nt, Artificial Sequence
  synthesized
ggcacccuggagaauuucaa

SEQ ID NO: 2966 - RNA, 20 nt, Artificial Sequence
  synthesized
ggggcaccccggagaauuuc

SEQ ID NO: 2967 - RNA, 20 nt, Artificial Sequence
  synthesized
ggggcacccuggagaauuuc

SEQ ID NO: 2968 - RNA, 20 nt, Artificial Sequence
  synthesized
ggggugccccaguggccugc

SEQ ID NO: 2969 - RNA, 20 nt, Artificial Sequence
  synthesized
uuaugcuugaaauucuccag

SEQ ID NO: 2970 - RNA, 20 nt, Artificial Sequence
  synthesized
uuaugcuugaaauucuccgg

SEQ ID NO: 2971 - RNA, 20 nt, Artificial Sequence
  synthesized
uucuccagggugccccagug

SEQ ID NO: 2972 - RNA, 20 nt, Artificial Sequence
  synthesized
uucuccggggugccccagug

SEQ ID NO: 2973 - RNA, 20 nt, Artificial Sequence
  synthesized
uugaaauucuccagggugcc

SEQ ID NO: 2974 - RNA, 20 nt, Artificial Sequence
  synthesized
uugaaauucuccggggugcc

SEQ ID NO: 2975 - RNA, 20 nt, Artificial Sequence
  synthesized
aagggaccuuccauacuuau

SEQ ID NO: 2976 - RNA, 20 nt, Artificial Sequence
  synthesized
aagguaccuucauuucaaau

SEQ ID NO: 2977 - RNA, 20 nt, Artificial Sequence
  synthesized
aagguaccuuccauacuuau

SEQ ID NO: 2978 - RNA, 20 nt, Artificial Sequence
  synthesized
aaggucccuucauuucaaau

SEQ ID NO: 2979 - RNA, 20 nt, Artificial Sequence
  synthesized
aaguauggaagguaccuuca

SEQ ID NO: 2980 - RNA, 20 nt, Artificial Sequence
  synthesized
aaguauggaaggucccuuca

SEQ ID NO: 2981 - RNA, 20 nt, Artificial Sequence
  synthesized
aaugaagggaccuuccauac

SEQ ID NO: 2982 - RNA, 20 nt, Artificial Sequence
  synthesized
aaugaagguaccuuccauac

SEQ ID NO: 2983 - RNA, 20 nt, Artificial Sequence
  synthesized
auaaguauggaagguaccuu

SEQ ID NO: 2984 - RNA, 20 nt, Artificial Sequence
  synthesized
auaaguauggaaggucccuu

SEQ ID NO: 2985 - RNA, 20 nt, Artificial Sequence
  synthesized
auggaagguaccuucauuuc

SEQ ID NO: 2986 - RNA, 20 nt, Artificial Sequence
  synthesized
auggaaggucccuucauuuc

SEQ ID NO: 2987 - RNA, 20 nt, Artificial Sequence
  synthesized
auuugaaaugaagggaccuu

SEQ ID NO: 2988 - RNA, 20 nt, Artificial Sequence
  synthesized
auuugaaaugaagguaccuu

SEQ ID NO: 2989 - RNA, 20 nt, Artificial Sequence
  synthesized
cagcauaaguauggaaggua

SEQ ID NO: 2990 - RNA, 20 nt, Artificial Sequence
  synthesized
cagcauaaguauggaagguc

SEQ ID NO: 2991 - RNA, 20 nt, Artificial Sequence
  synthesized
gaaaugaagggaccuuccau

SEQ ID NO: 2992 - RNA, 20 nt, Artificial Sequence
  synthesized
gaaaugaagguaccuuccau

SEQ ID NO: 2993 - RNA, 20 nt, Artificial Sequence
  synthesized
gaccuuccauacuuaugcug

SEQ ID NO: 2994 - RNA, 20 nt, Artificial Sequence
  synthesized
gcauaaguauggaagguacc

SEQ ID NO: 2995 - RNA, 20 nt, Artificial Sequence
  synthesized
gcauaaguauggaagguccc

SEQ ID NO: 2996 - RNA, 20 nt, Artificial Sequence
  synthesized
ggaagguaccuucauuucaa

SEQ ID NO: 2997 - RNA, 20 nt, Artificial Sequence
  synthesized
ggaaggucccuucauuucaa

SEQ ID NO: 2998 - RNA, 20 nt, Artificial Sequence
  synthesized
gggaccuuccauacuuaugc

SEQ ID NO: 2999 - RNA, 20 nt, Artificial Sequence
  synthesized
gguaccuucauuucaaauac

SEQ ID NO: 3000 - RNA, 20 nt, Artificial Sequence
  synthesized
gguaccuuccauacuuaugc

SEQ ID NO: 3001 - RNA, 20 nt, Artificial Sequence
  synthesized
ggucccuucauuucaaauac

SEQ ID NO: 3002 - RNA, 20 nt, Artificial Sequence
  synthesized
guauggaagguaccuucauu

SEQ ID NO: 3003 - RNA, 20 nt, Artificial Sequence
  synthesized
guauggaaggucccuucauu

SEQ ID NO: 3004 - RNA, 20 nt, Artificial Sequence
  synthesized
guauuugaaaugaagggacc

SEQ ID NO: 3005 - RNA, 20 nt, Artificial Sequence
  synthesized
guauuugaaaugaagguacc

SEQ ID NO: 3006 - RNA, 20 nt, Artificial Sequence
  synthesized
uaccuucauuucaaauacca

SEQ ID NO: 3007 - RNA, 20 nt, Artificial Sequence
  synthesized
uaccuuccauacuuaugcug

SEQ ID NO: 3008 - RNA, 20 nt, Artificial Sequence
  synthesized
ucccuucauuucaaauacca

SEQ ID NO: 3009 - RNA, 20 nt, Artificial Sequence
  synthesized
ugaagggaccuuccauacuu

SEQ ID NO: 3010 - RNA, 20 nt, Artificial Sequence
  synthesized
ugaagguaccuuccauacuu

SEQ ID NO: 3011 - RNA, 17 nt, Artificial Sequence
  17 nucleotide guide sequence 1
cgucagguuaaacucca

SEQ ID NO: 3012 - RNA, 17 nt, Artificial Sequence
  17 nucleotide guide sequence 2
ccgucagguuaaacucc

SEQ ID NO: 3013 - RNA, 17 nt, Artificial Sequence
  17 nucleotide guide sequence 3
uccgucagguuaaacuc

SEQ ID NO: 3014 - RNA, 17 nt, Artificial Sequence
  17 nucleotide guide sequence 4
auccgucagguuaaacu

What is claimed is:

1. A method for inactivating a mutant Bestrophin 1 (BEST1) allele in a cell comprising a mutant BEST1 allele and a functional BEST1 allele, the method comprising delivering to the cell a composition comprising
   a) a first RNA molecule which comprises a guide sequence portion having 17-24 nucleotides and which targets a rs1800009 single nucleotide polymorphism (SNP) position in the mutant BEST1 allele;
   b) a second RNA molecule which comprises a guide sequence portion having 17-24 nucleotides and which targets a sequence present in an intron of both the mutant BEST1 allele and the functional BEST1 allele; and
   c) an RNA guided CRISPR nuclease,
wherein the first and second RNA molecules either (1) are guide RNA molecules comprising a portion having a sequence which binds to a CRISPR nuclease, or (2) comprise a portion having a tracr mate sequence and the composition further comprises a tracrRNA molecule that hybridizes with the tracr mate sequence,
wherein the sequence of the rs1800009 SNP position in the mutant BEST1 allele differs from the sequence of the rs1800009 SNP position in the functional BEST1 allele,
wherein the first RNA molecule and the RNA guided CRIPSR nuclease form a complex that creates a double strand break in the mutant BEST1 allele,
wherein the second RNA molecule and the RNA guided CRIPSR nuclease form a complex that creates a double strand break in an intron of both the mutant BEST1 allele and the functional BEST1 allele, and
wherein a portion of the mutant BEST1 allele is excised.

2. The method of claim 1, wherein the first and/or second RNA molecules are guide RNA molecules comprising a portion having a sequence which binds to a CRISPR nuclease, wherein said sequence is a tracrRNA sequence.

3. The method of claim 1, wherein the first and/or second RNA molecules comprise one or more linker portions.

4. The method of claim 1, wherein the first and/or second RNA molecules are up to 300 nucleotides in length.

5. The method of claim 1, wherein the first and/or second RNA molecules comprise a portion having a tracr mate sequence and the composition comprises a tracrRNA molecule.

6. The method of claim 1, wherein the sequence of the 17-24 nucleotides of the guide sequence portion of the second RNA molecule is different than sequence of the 17-24 nucleotides of the guide sequence portion of the first RNA molecule.

7. The method of claim 1, wherein the inactivating results in a truncated protein encoded by the mutated allele and a functional protein encoded by the functional allele.

8. The method of claim 1, wherein the RNA guided CRISPR nuclease utilizes a NGG protospacer adjacent motif (PAM).

9. The method of claim 1, wherein the RNA guided CRISPR nuclease is a *Streptococcus pyogenes* Cas9 nuclease or a *Staphylococcus aureus* Cas9 nuclease.

10. The method of claim 8, wherein the guide sequence portion of the first RNA molecule comprises 17-20 contiguous nucleotides set forth in any one of SEQ ID NOs: 102-109 and 960-991.

11. The method of claim 8, wherein the guide sequence portion of the first RNA molecule comprises 17-20 contiguous nucleotides set forth in SEQ ID NO: 108 or SEQ ID NO: 109.

\* \* \* \* \*